(12) United States Patent
Bruening et al.

(10) Patent No.: US 10,894,078 B2
(45) Date of Patent: Jan. 19, 2021

(54) HIV VACCINES COMPRISING ONE OR MORE POPULATION EPISENSUS ANTIGENS

(71) Applicants: Vir Biotechnology, Inc., San Francisco, CA (US); Triad National Security, LLC, Los Alamos, NM (US); Oregon Health & Science University, Portland, OR (US)

(72) Inventors: Eric Bruening, Damascus, OR (US); Klaus Frueh, Portland, OR (US); Louis Picker, Portland, OR (US); Bette T. M. Korber, Santa Fe, NM (US); James Theiler, Santa Fe, NM (US); Emily Marshall, Portland, OR (US)

(73) Assignees: Vir Biotechnology, Inc., San Francisco, CA (US); Triad National Security, LLC, Los Alamos, NM (US); Oregon Health & Science University, Portland, OR (US)

( * ) Notice: Subject to any disclaimer, the term of this patent is extended or adjusted under 35 U.S.C. 154(b) by 125 days.

(21) Appl. No.: 15/516,491

(22) PCT Filed: Oct. 5, 2015

(86) PCT No.: PCT/US2015/054067
§ 371 (c)(1),
(2) Date: Apr. 3, 2017

(87) PCT Pub. No.: WO2016/054654
PCT Pub. Date: Apr. 7, 2016

(65) Prior Publication Data
US 2017/0319679 A1 Nov. 9, 2017

Related U.S. Application Data

(60) Provisional application No. 62/059,506, filed on Oct. 3, 2014, provisional application No. 62/059,497, filed on Oct. 3, 2014.

(51) Int. Cl.
*A61K 39/12* (2006.01)
*C12N 15/86* (2006.01)
*A61K 39/21* (2006.01)
*A61K 39/00* (2006.01)

(52) U.S. Cl.
CPC .............. *A61K 39/12* (2013.01); *A61K 39/21* (2013.01); *C12N 15/86* (2013.01); *A61K 2039/53* (2013.01); *A61K 2039/70* (2013.01); *C12N 2710/16143* (2013.01); *C12N 2740/16034* (2013.01); *C12N 2740/16222* (2013.01); *C12N 2740/16234* (2013.01); *C12N 2740/16322* (2013.01); *C12N 2740/16334* (2013.01)

(58) Field of Classification Search
CPC .................. A61K 39/12; C12N 15/86; C12N 2740/16222; C12N 2740/16334; C12N 2740/16322; C12N 2710/16143; C12N 2740/16034
See application file for complete search history.

(56) References Cited

U.S. PATENT DOCUMENTS

| | | | |
|---|---|---|---|
| 7,498,314 B2 * | 3/2009 | Krohn | A61P 31/18 514/44 R |
| 9,249,427 B2 | 2/2016 | Picker et al. | |
| 9,750,801 B2 | 9/2017 | Barouch et al. | |
| 9,783,823 B2 | 10/2017 | Picker et al. | |
| 9,982,241 B2 | 5/2018 | Picker et al. | |
| 10,137,191 B2 | 11/2018 | Barouch et al. | |
| 10,369,214 B2 | 8/2019 | Langedijk et al. | |

(Continued)

FOREIGN PATENT DOCUMENTS

| AU | 2011203095 A1 | 7/2011 |
|---|---|---|
| WO | 03/025003 A2 | 3/2003 |

(Continued)

OTHER PUBLICATIONS

Gallo, R. C., Nov. 2005, The end or the beginning of the drive to an HIV-preventive vaccine: a view from over 20 years, Lancet 366:1894-98.*

(Continued)

*Primary Examiner* — Jeffrey S Parkin
(74) *Attorney, Agent, or Firm* — Seed Intellectual Property Law Group LLP

(57) ABSTRACT

Provided herein are HIV-1 vaccines comprising a carrier and a population episensus antigen determined using the EpiGraph approach. Also provided are HIV-1 vaccines comprising a carrier, a population episensus antigen, and a tailored antigen. Also provided are methods of designing and producing an HIV-1 vaccine for a subject comprising designing vaccine antigens to optimally cover the diversity within a geographic area using an antigen amino acid sequence generated using the EpiGraph approach, and producing said designed vaccine antigen. Also provided are methods of inducing an effector memory T cell response comprising designing the one or more EpiGraph amino acid sequences, producing a vaccine comprising the one or more EpiGraph amino acid sequences and a vector, and administering the vaccine to a subject. Further provided are methods of treating HIV-1 in a subject comprising administering an effective amount of the described HIV-1 vaccines to the subject in need thereof.

26 Claims, 13 Drawing Sheets
Specification includes a Sequence Listing.

(56) References Cited

U.S. PATENT DOCUMENTS

| | | | |
|---|---|---|---|
| 2007/0054262 A1* | 3/2007 | Baker | G01N 33/569 |
| | | | 435/5 |
| 2008/0199493 A1 | 8/2008 | Picker et al. | |
| 2009/0324631 A1 | 12/2009 | Korber et al. | |
| 2010/0183651 A1 | 7/2010 | Finnefrock et al. | |
| 2011/0123485 A1 | 5/2011 | Desrosiers et al. | |
| 2013/0142823 A1 | 6/2013 | Picker et al. | |
| 2014/0073525 A1 | 3/2014 | Chang et al. | |
| 2014/0141038 A1 | 5/2014 | Picker et al. | |
| 2014/0186384 A1 | 7/2014 | Weiner et al. | |

FOREIGN PATENT DOCUMENTS

| | | |
|---|---|---|
| WO | 03/035097 A1 | 5/2003 |
| WO | 2010/059732 A1 | 5/2010 |
| WO | 2011/143653 A2 | 11/2011 |
| WO | 2014/107744 A1 | 7/2014 |
| WO | 2014/138209 A1 | 9/2014 |
| WO | 2016/011293 A1 | 1/2016 |

OTHER PUBLICATIONS

West, Jr., A. P., et al., Feb. 2014, Structural insights on the role of antibodies in HIV-1 vaccine and therapy, Cell 156:633-638.*
Stephenson, K. E., et al., 2016, New concepts in HIV-1 vaccine development, Curr. Opin. Immunol. 41:39-46.*
Lewis, G. K., et al., Nov. 2014, Antibody persistence and T-cell balance: two key factors confronting HIV vaccine development, PNAS 111(44):15614-15621.*
Barouch et al., "Mosaic HIV-1 Vaccines Expand the Breadth and Depth of Cellular Immune Responses in Rhesus Monkeys," *Nat Med.*16(3):319-323, 2010. (15 pages).
Bock et al., "EpiGRAPH: user-friendly software for statistical analysis and prediction of (epi)genomic data," *Genome Biology* 10(2):R14, 2009. (14 pages).
Database GenBank, "gag protein, partial [Human immunodeficiency virus 1]," ABO61536.1, Nov. 30, 2007, 1 page.
Database GenBank, "nef protein [Human immunodeficiency virus 1]," AGV52258.1, Sep. 18, 2013, 1 page.
Database GenBank, "nef protein [Human immunodeficiency virus 1]," AIK02824.1, Aug. 21, 2014, 1 page.
Database GenBank, "nef protein, partial [Human immunodeficiency virus 1]," ACM67113.1, Jun. 25, 2013, 1 page.
Fischer et al., "Polyvalent vaccines for optimal coverage of potential T-cell epitopes in global HIV-1 variants," *Nature Medicine* 13(1):100-106, 2007.
Hansen et al., "Cytomegalovirus Vectors Violate CD8+ T Cell Epitope Recognition Paradigms," *Science* 340(6135):1237874, 2013. (34 pages).
Kirovski et al., "Combinatorics of the Vaccine Design Problem: Definition and an Algorithm," Microsoft Research, Technical Report MSR-TR-2007-148, Nov. 2007, 11 pages.
Korber, "LANL/New Mexico Consortium HIV vaccine design and Analysis," Los Alamos National Laboratory, LA-UR-14-25023, Jul. 7, 2014, 10 pages.
Santra et al., "Breadth of cellular and humoral immune responses elicited in rhesus monkeys by multi-valent mosaic and consensus immunogens," *Virology* 428:121-127, 2012.
Theiler et al., "Epigraph: A Vaccine Design Tool Applied to an HIV Therapeutic Vaccine and a Pan-Filovirus Vaccine," *Sci Rep.* 6:33987, 2016. (15 pages).
Thurmond et al. "Web-based design and evaluation of T-cell vaccine candidates," *Bioinformatics* 24(14):1639-1640, 2008.
Hansen et al., "Effector memory T cell responses are associated with protection of rhesus monkeys from mucosal simian immunodeficiency virus challenge," *Nature Medicine* 15(3):293-299 (2009).
Hansen et al., "Immune clearance of highly pathogenic SIV infection," *Nature* 502:100-104 (2013).
Hansen et al., "Profound early control of highly pathogenic SIV by an effector memory T-cell vaccine," *Nature* 473:523-527 (2011).
Barouch et al., "Protective Efficacy of a Global HIV-1 Mosaic Vaccine against Heterologous SHIV Challenges in Rhesus Monkeys," Cell 155(3):531-539, 2013.
ClinicalTrials.gov, Identifier NCT02315703, Safety, Tolerability, and Immunogenicity Study of Homologous Ad26 Mosaic Vector Vaccine Regimens or Heterologous Ad26 Mosaic and MVA Mosaic Vector Vaccine Regimens With Glycoprotein 140 (gp140) for Human Immunodeficiency Virus (HIV) Prevention, First posted Dec. 12, 2014, available from: https://clinicaltrials.gov/ct2/show/NCT02315703?term=NCT02315703.
Novitsky et al., "Human Immunodeficiency Virus Type 1 Subtype C Molecular Phylogeny: Consensus Sequence for an AIDS Vaccine Design?" *Journal of Virology* 76(11): 5435-5451, 2002.
Protein Nef, UniProt, Oct. 19, 2011, G1BWA6, URL, https://www.uniprot.org/uniprot/G1BWA6 (8 pages).
Santra et al., "Mosaic vaccines elicit CD8$^+$ T lymphocyte responses that confer enhanced immune coverage of diverse HIV strains in monkeys," *Nature Medicine* 16(3):324-329, 2010.
Barouch et al., "HIV-1 Vaccine Development After STEP," *Annu Rev Med.* 61:153, 2010 (NIH Public Access Author Manuscript, available in PMC Jan. 1, 2011) (19 pages).
Korber et al., "T-Cell Vaccine Strategies for Human Immunodeficiency Virus, the Virus with a Thousand Faces," *Journal of Virology* 83(17):8300-8314, 2009.
Lacerda et al., "Identification of broadly neutralizing antibody epitopes in the HIV-1 envelope glycoprotein using evolutionary models," *Virology Journal* 10:347, 2013 (18 pages).

* cited by examiner

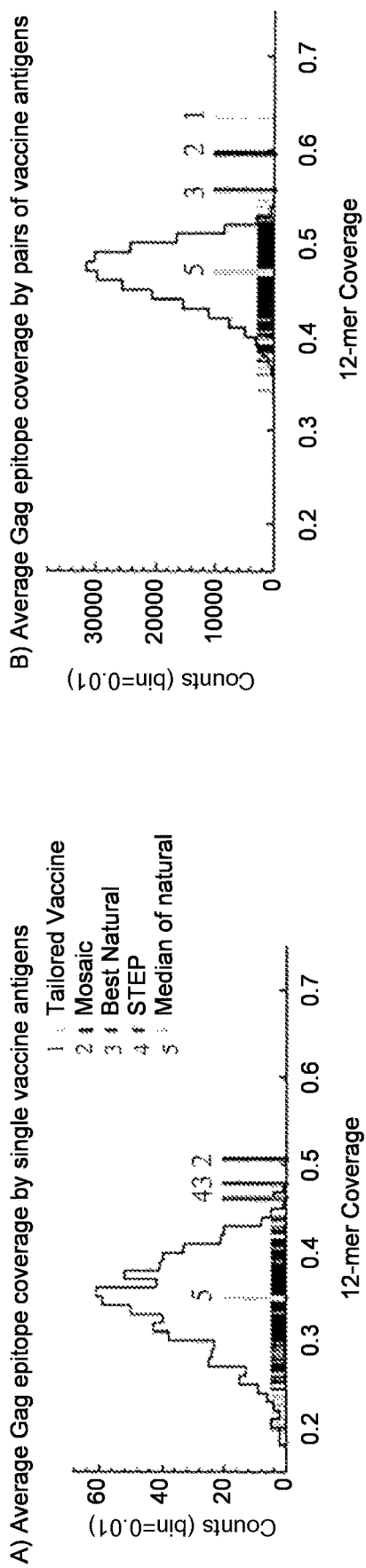
FIG. 8A-B

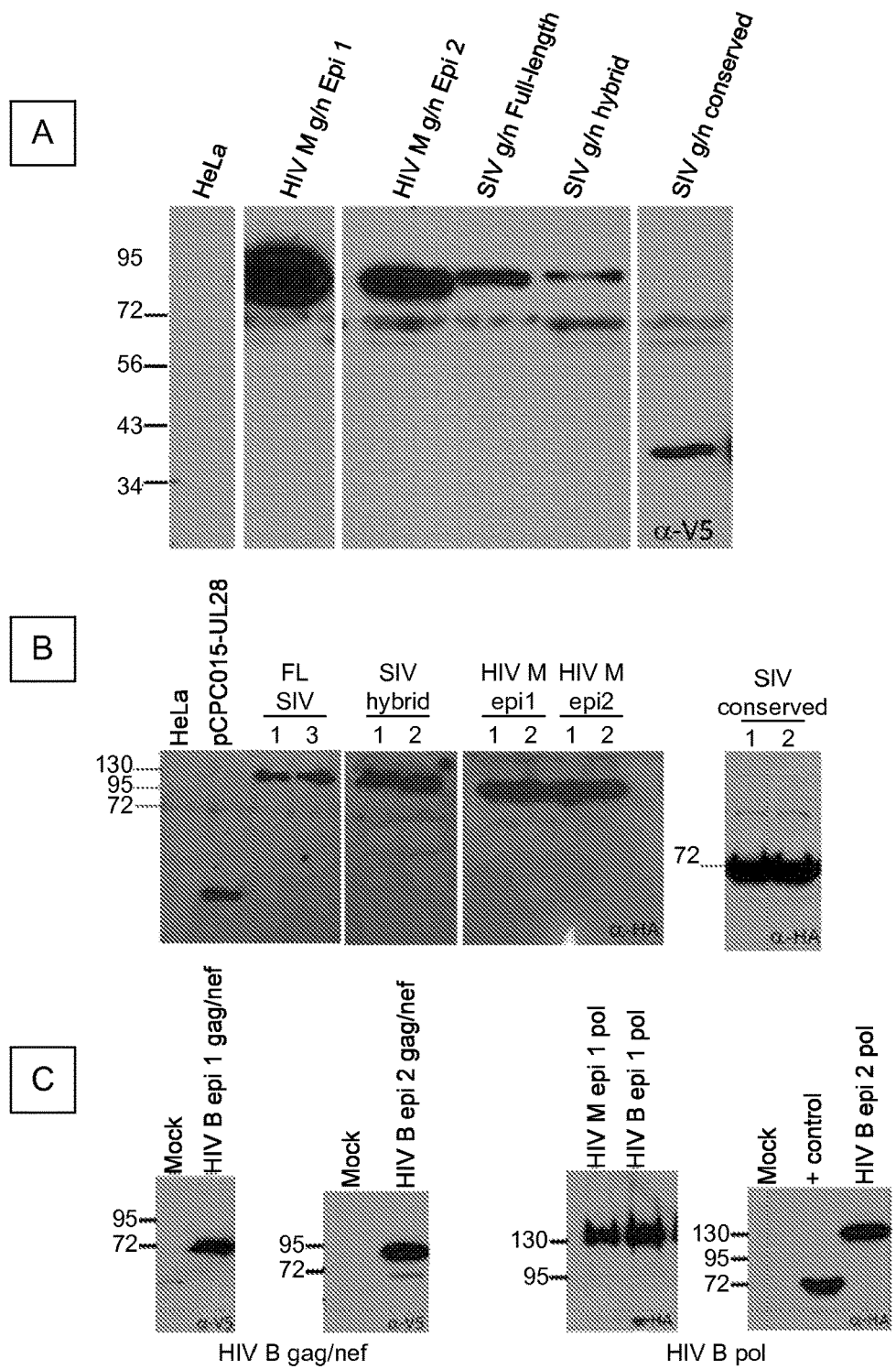
FIG. 9A-C

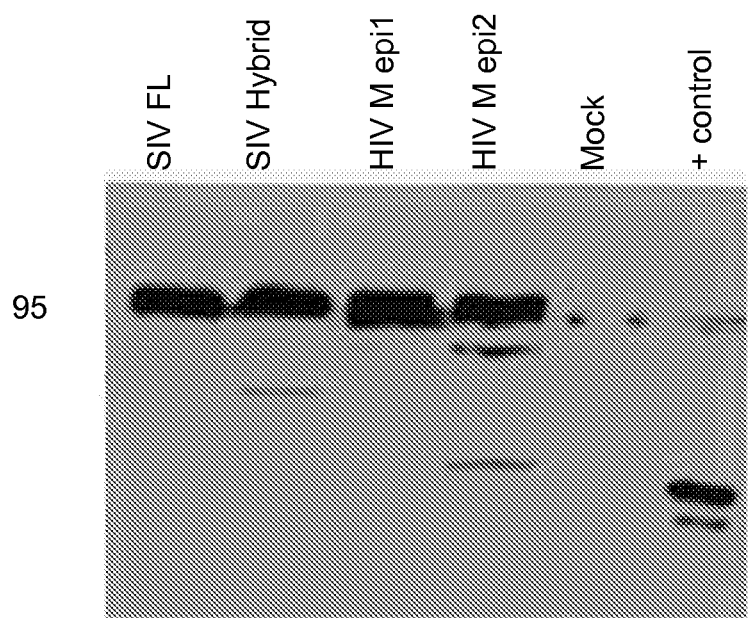
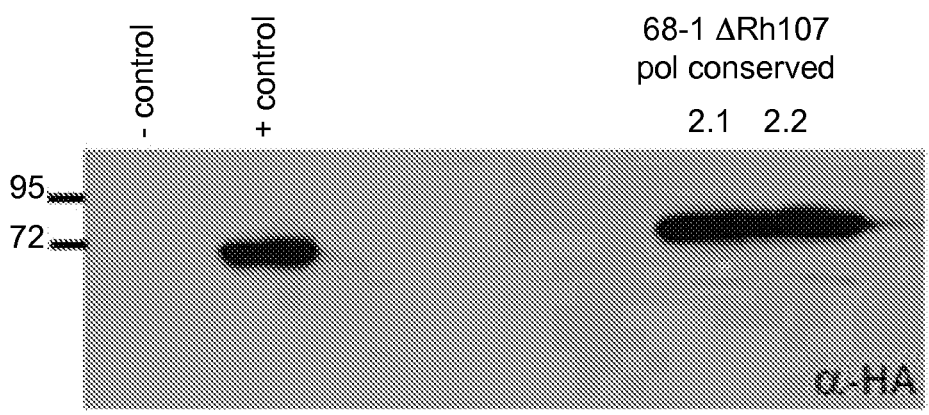
FIG. 10A-B

HIV VACCINES COMPRISING ONE OR MORE POPULATION EPISENSUS ANTIGENS

CROSS-REFERENCE TO RELATED APPLICATIONS

This application is the National State Entry of International Application No. PCT/US2015/054067, filed Oct. 5, 2015, and claims priority benefit to U.S. Provisional Patent Application Ser. No. 62/059,497, filed Oct. 3, 2014, and U.S. Provisional Patent Application Ser. No. 62/059,506, filed Oct. 3, 2014, each of which is hereby incorporated by reference herein in its entirety.

STATEMENT OF GOVERNMENT INTEREST

This invention was made with government support under AI100343 awarded by the National Institutes of Health. The Government has certain rights in the invention.

REFERENCE TO SEQUENCE LISTING SUBMITTED ELECTRONICALLY

The content of the electronically submitted sequence listing in ASCII text file (Name: 3919_0100002_Substitute_Sequence_Listing.txt; Size: 3,624,960 bytes; and Date of Creation: Jul. 27, 2017) filed with the application is incorporated herein by reference in its entirety.

FIELD OF THE INVENTION

The present subject matter relates, in general, to HIV and, in particular, to HIV vaccines.

BACKGROUND OF THE INVENTION

In 2013, there were approximately 2.3 million new human immunodeficiency virus (HIV) infections, over 35 million people living with HIV, and 1.6 million acquired immune deficiency syndrome (AIDS) deaths. While great progress has been made in the treatment of HIV/AIDS, all individuals living with HIV will have to be treated with anti-retroviral therapy (ART) for the rest of their lives since drug therapy is unable to clear latent viral reservoirs that exist in resting CD4+ T cells at a frequency of about $1/10^6$ cells. See, Eriksson, S. 2013. *PLoS Pathog* 9:e1003174.

Major strategies to purge latent HIV reservoirs are generally aimed at reactivating latent virus using histone-deacetylase (HDAC) inhibitors, however clinical studies with HDAC-inhibitors have not consistently decreased latent reservoirs. One likely reason for this lies with the inability of HIV-specific CD8+ T cells to eliminate resting CD4+ T cells.

Only a few cases have been documented where HIV-1 has been cleared from an individual with a pre-existing infection. Until an effective therapy is developed, the estimated 35 million individuals living with HIV-1 will remain on antiviral drugs to suppress a viral reservoir that has resisted all efforts at eradication.

A cure for AIDS has been elusive, but recent work suggests that stringent immunological control can clear HIV over time. Specifically, it was found that rhesus macaques (RM) vaccinated with cytomegalovirus (CMV)-based vectors expressing simian immunodeficiency virus (SIV) antigens were initially infected, but SIV was undetectable by several stringent criteria one to two years after infection. This result is even more remarkable in light of the fact that the highly virulent SIVmac239 strain used in these studies has thwarted all previous vaccine attempts. These results have expanded the current paradigm from one focused on a preventative HIV vaccine to one in which an immunotherapy for HIV/AIDS will eventually become an essential part of the fight against this pandemic. Thus, in addition to a preventative vaccine, there remains a need for an effective therapy to treat individuals living with HIV-1. Specifically, there remains a need to design, manufacture, and test prophylactic and therapeutic HIV vaccines in preparation for clinical testing.

SUMMARY OF THE INVENTION

Provided herein are HIV/SIV polypeptides comprising one or more EpiGraph antigen sequences comprising amino acid sequences corresponding to HIV/SIV Gag, Nef, Pol, Env, including full-length sequences, portions thereof, or any combination thereof. Also provided herein are HIV/SIV polypeptides comprising one or more population episensus antigen sequences comprising amino acid sequences corresponding to HIV/SIV Gag, Nef, Pol, Env, or a combination thereof. Also provided herein are one or more carriers comprising HIV/SIV polypeptides comprising one or more population episensus antigen sequences. Further provided herein are HIV/SIV polypeptides comprising one or more tailored antigen sequences comprising amino acid sequences corresponding to HIV/SIV Gag, Nef, Pol, Env, or a combination thereof. The HIV/SIV polypeptides of the present disclosure can comprise one or more HIV-1 tailored antigens, wherein the polypeptide comprises an amino acid sequence selected from the group consisting of: SEQ ID NOs: 692-696 and SEQ ID NOs: 754-789. Also provided herein are one or more carriers comprising HIV/SIV polypeptides comprising one or more tailored antigen sequences. EpiGraph antigen sequences having SEQ ID NOs: 691-789 are provided herein.

Provided herein are HIV-1 vaccines comprising one or more carriers and one or more population episensus antigens. Also provided herein are HIV-1 vaccines comprising a vector capable of expressing a population episensus antigen and one or more tailored antigens.

In some embodiments, the HIV-1 population episensus antigen comprises epitopes from Gag, Pol, Nef, Env, Tat, Rev, Vpr, Vif, or Vpu. In some embodiments, the HIV-1 population episensus antigen is a fusion antigen comprising two or more HIV-1 population episensus antigens. In some embodiments, the HIV-1 population episensus antigen is central to the HIV-1 B clade epidemic in the United States. In some embodiments, the HIV-1 population episensus antigen is central to the HIV-1 C clade epidemic in South Africa. In some embodiments, the HIV-1 population episensus antigen is central to the HIV-1 2-clade regional epidemic in Thailand. In some embodiments, the HIV-1 population episensus antigen is central to the HIV-1 M-group global set.

In some embodiments, the HIV-1 population episensus antigen comprises epitopes from Gag. In some embodiments, the HIV-1 population episensus antigen comprises epitopes from a conserved region of HIV-1. In some embodiments, the HIV-1 population episensus antigen comprises epitopes from a conserved region of Gag, Pol, or Nef. In some embodiments, the epitopes from the conserved region of Gag are epitopes from the p24 capsid protein of Gag.

In some embodiments, the HIV-1 tailored antigen comprises epitopes from Gag, Pol, Nef, Env, Tat, Rev, Vpr, Vif, or Vpu. In some embodiments, the HIV-1 tailored antigen is central to the HIV-1 M-group global set. In some embodiments, the HIV-1 tailored antigen is central to the HIV-1 C clade epidemic in South Africa. In some embodiments, the HIV-1 tailored antigen is central to the HIV-1 B clade epidemic in the United States.

Further provided are methods of preventing or treating HIV-1 infection in a subject comprising administering an effective amount of the described HIV-1 vaccines to the subject in need thereof. Further provided are methods of designing and producing an HIV-1 vaccine for a subject comprising sequencing HIV-1 viruses in an individual, selecting vaccine antigens designed to optimally cover the diversity within a geographic area, and inserting the vaccine antigens into a vector. Also provided herein are methods of treating an HIV-1 infection in a subject comprising administering an effective amount of the disclosed vaccines to the subject in need thereof.

Also provided herein are HIV-1 vaccines comprising one or more carriers and a population episensus antigen determined using the EpiGraph approach. Further provided herein are methods of designing vaccine antigens to optimally cover the diversity within a geographic area using a vaccine antigen amino acid sequence generated using the EpiGraph method of antigen amino acid sequence selection and producing said designed vaccine antigen. Further provided herein are methods of designing and producing an HIV-1 vaccine for a subject comprising determining the amino acid sequence of HIV-1 viruses in an individual by sequencing, selecting vaccine antigens designed to optimally cover the diversity within a geographic area using a vaccine antigen amino acid sequence generated using the EpiGraph method of antigen amino acid sequence selection, and inserting the vaccine antigens into a vector.

Also provided herein are methods of inducing an effector memory T cell response comprising determining one or more EpiGraph amino acid sequences, generating a vaccine comprising the one or more EpiGraph antigen amino acid sequences and one or more carriers, and administering the vaccine to a subject in need thereof. Further provided are methods of treating HIV-1 in a subject comprising administering an effective amount of the described HIV-1 vaccines to the subject in need thereof. Also provided herein are methods of protecting from an HIV-1 infection in a subject comprising administering an effective amount of the described HIV-1 vaccines to the subject in need thereof.

BRIEF DESCRIPTION OF THE DRAWINGS

FIG. 6A shows the comparison for the full Gag protein. FIG. 6B shows comparisons for only the conserved p24 region.

FIG. 8 shows the average potential Gag epitope coverage of the HIV-1 B clade U.S. sequences by different vaccine antigens. FIG. 8A shows the average Gag epitope coverage by single vaccine antigens, and FIG. 8B shows the average Gag epitope coverage by pairs of vaccine antigens.

FIGS. 9A-C show that EpiGraph designed synthetic HIV antigens are expressed as full-length proteins. HeLa cells were transfected with expression plasmids encoding: fusion proteins of gag and nef for HIV or SIV (HIV M group EpiGraph 1 [SEQ ID NO: 705] and HIV M group EpiGraph 2 [SEQ ID NO: 707], SIVmac239 full length proteins, SIV variants hybrid proteins [SEQ ID NO: 713], and SIV conserved portions of gag and nef [SEQ ID NO: 714]), as represented in FIG. 9A; polymerase proteins of HIV or SIV (SIVmac239 full-length (FL), SIV variants hybrid proteins [SEQ ID NO: 715], (HIV M group EpiGraph 1[SEQ ID NO: 709] and HIV M group EpiGraph 2 [SEQ ID NO: 711], and SIV conserved portions of pol [SEQ ID NO: 716]), as represented in FIG. 9B; and fusion proteins of gag and nef for HIV (clade B EpiGraph 1 gag/nef [SEQ ID NO: 701]) and clade B EpiGraph 2 gag/nef [SEQ ID NO: 702]) and polymerase proteins for HIV (clade M epi 1 pol [SEQ ID NO: 709]); clade B EpiGraph 1 pol [SEQ ID NO: 703]); clade B EpiGraph 2 pol [SEQ ID NO: 704]), as represented in FIG. 9C. All gag/nef constructs include a carboxy-terminal V5 tag (FIG. 9A), and all pol constructs include a carboxy-terminal HA tag (FIGS. 9B and 9C). For FIG. 9B, 1 and 2 indicate multiple clones of each construct. Lysates were harvested at 48 hours post-transfection and immunoblotted using V5 (FIG. 9A) or HA (FIGS. 9B and 9C) antibodies. The observed molecular weight of the proteins is consistent with the predicted molecular weight for each of the constructs.

FIGS. 10A-B show that EpiGraph designed synthetic antigens are expressed by CMV vectors. As represented in FIG. 10A, RhCMV strain 68-1 expressing SIVmac 239 polymerase full-length (FL), a hybrid of SIV polymerases from different SIV variants [SEQ ID NO: 715], a synthetic polymerase gene based on global M group HIV EpiGraph 1 [SEQ ID NO: 709] or global M group HIV EpiGraph 2 [SEQ ID NO: 711] were constructed by BAC mutagenesis and reconstituted in telomerized Rhesus fibroblasts. As represented in FIG. 10B, RhCMV strain 68-1 expressing SIVmac239 conserved regions of the polymerase constructs [SEQ ID NO: 716] were also constructed by BAC mutagenesis and reconstituted in telomerized Rhesus fibroblasts. In all vectors, antigen expression is driven by the endogenous viral Rh107 promoter. Cell pellets were harvested at full CPE and immunoblotted for the HA tag expressed at the carboxy-terminus of each protein. For pol conserved, two independent clones (2.1 and 2.2) are shown in FIG. 10B.

DETAILED DESCRIPTION OF ILLUSTRATIVE EMBODIMENTS

Figure 1A:
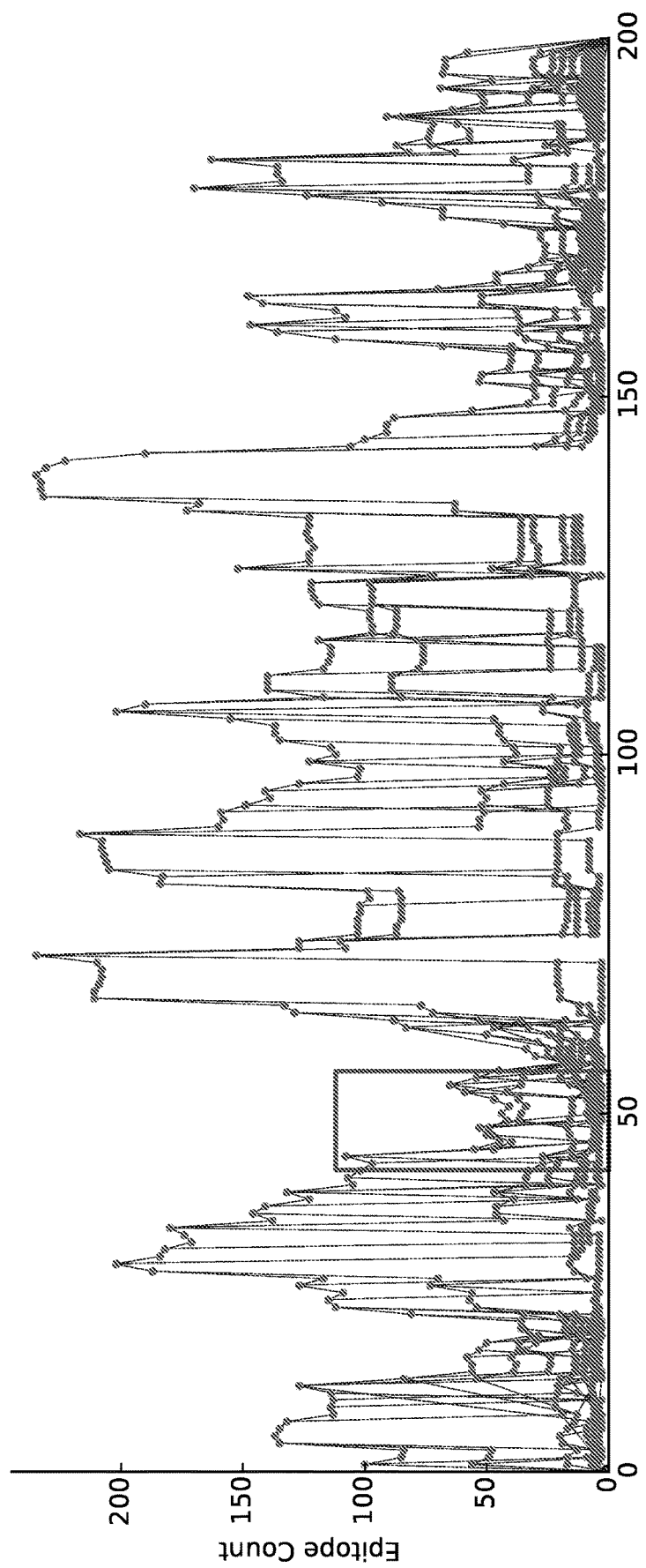
FIG. 1A shows a full graph for the CRF01-AE clade of the Nef protein. The rectangle is an inset shown in FIG. 1B.

Various terms relating to aspects of the description are used throughout the specification and claims. Such terms are to be given their ordinary meaning in the art unless otherwise indicated. Other specifically defined terms are to be construed in a manner consistent with the definitions provided herein.

As used in this specification and the appended claims, the singular forms "a," "an," and "the" include plural referents unless the content clearly dictates otherwise. Thus, for example, reference to "a cell" includes a combination of two or more cells, and the like.

The term "about" as used herein when referring to a measurable value such as an amount, a temporal duration, and the like, is meant to encompass variations of up to ±20% from the specified value, as such variations are appropriate to perform the disclosed methods. Unless otherwise indicated, all numbers expressing quantities of ingredients, properties such as molecular weight, reaction conditions, and so forth used in the specification and claims are to be understood as being modified in all instances by the term "about." Accordingly, unless indicated to the contrary, the numerical parameters set forth in the following specification and attached claims are approximations that may vary depending upon the desired properties sought to be obtained by the present invention. At the very least, and not as an attempt to limit the application of the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. Any numerical value, however, inherently contain certain errors necessarily resulting from the standard deviation found in their respective testing measurements.

As employed above and throughout the disclosure the term "effective amount" refers to an amount effective, at dosages, and for periods of time necessary, to achieve the desired result with respect to the treatment of the relevant disorder, condition, or side effect. It will be appreciated that the effective amount of components of the present invention will vary from patient to patient not only with the particular vaccine, component or composition selected, the route of administration, and the ability of the components to elicit a desired result in the individual, but also with factors such as the disease state or severity of the condition to be alleviated, hormone levels, age, sex, weight of the individual, the state of being of the patient, and the severity of the pathological condition being treated, concurrent medication or special diets then being followed by the particular patient, and other factors which those skilled in the art will recognize, with the appropriate dosage being at the discretion of the attending physician. Dosage regimes may be adjusted to provide the improved therapeutic response. An effective amount is also one in which any toxic or detrimental effects of the components are outweighed by the therapeutically beneficial effects.

The term "administering" means either directly administering a compound or composition of the present invention, or administering a prodrug, derivative or analog which will form an equivalent amount of the active compound or substance within the body.

The terms "subject," "individual," and "patient" are used interchangeably herein, and refer to an animal, for example a human, to whom treatment, including prophylactic treatment, with the pharmaceutical composition according to the present invention, is provided. The term "subject" as used herein refers to human and non-human animals. The terms "non-human animals" and "non-human mammals" are used interchangeably herein and include all vertebrates, e.g., mammals, such as non-human primates, (particularly higher primates), sheep, dog, rodent, (e.g., mouse or rat), guinea pig, goat, pig, cat, rabbits, cows, horses and non-mammals such as reptiles, amphibians, chickens, and turkeys.

The term "cocktail" refers to a set of antigens intended to be delivered in combination to a patient.

The term "episensus" refers to an epitope based consensus sequence. It is a sequence whose epitopes match, as closely as possible, the epitopes in a reference set of natural sequences. The terms "epitope" and "potential epitope" refer to a sequence of k characters (typically k is in the range of 8-12), often in the context of a k-character subsequence of a much longer natural or vaccine antigen sequence. T cells can recognize such peptides in an immune response.

The term "EpiGraph" refers to a new computational strategy developed to create sequences that provide an optimal episensus sequence, or set of sequences that combined provide optimal coverage of a population of diverse viral sequences.

The terms "EpiGraph sequence" or "Episensus antigen" refer to the vaccine inserts designed based on the EpiGraph algorithm.

The term "population episensus antigen" refers to a sequence derived with the EpiGraph algorithm, which are "central" to a population of HIV sequences. The population could be a specific HIV clade, cluster of sequences derived using our Tailored epitope based clustering algorithm, or the global epidemic. "Central" is defined in terms of sharing potential epitopes, so it is a computationally-derived sequence that provides the maximal average epitope coverage of the population.

EpiGraph sequences can be used as a solution for a prophylactic, preventive vaccine, or can be adopted as part of more complex strategies for the design of therapeutic vaccines that would be tailored to match individual infections. The term "tailored vaccine set" refers to a set of vaccine antigen sequences designed for manufacture, from which a subset antigens could be selected to best match a patient's virus for delivery as a therapeutic vaccine.

The term "tailored antigen" or "tailored episensus antigen" refers to one or more amino acid sequences from the "tailored vaccine set" that would be specifically selected based on a best match to a patient's infecting HIV-1 strain. for delivery to that patient as a therapeutic vaccine.

As used herein, the terms "treatment" or "therapy" (as well as different forms thereof, including curative or palliative) refer to treatment of an infected person. As used herein, the term "treating" includes alleviating or reducing at least one adverse or negative effect or symptom of a condition, disease or disorder. This condition, disease or disorder can be HIV infection.

As used herein, the terms "prevention" or "prophylaxis" refer to preventing a subject from becoming infected with, or reducing the risk of a subject from becoming infected with, or halting transmission of, or the reducing the risk of transmission of, for example, HIV, SIV, or a related virus.

"Pharmaceutically acceptable" refers to those compounds, materials, compositions, and/or dosage forms which are, within the scope of sound medical judgment, suitable for contact with the tissues of human beings and animals without excessive toxicity, irritation, allergic response, or other problem complications commensurate with a reasonable benefit/risk ratio.

Vectors that can be used include, but are not limited to, plasmids, bacterial vectors, and viral vectors. Viral vectors include cytomegalovirus (CMV) vectors. An advantage of these CMV vectors for use in therapeutic vaccine delivery is that they create a new CD8+ T cell epitope paradigm and induce more potent and enduring responses. It has been shown in animal models that vaccines based on these viral vectors can clear viral infections (Hansen, S. G. 2013. Science 340:1237874), and so these approaches have promise for a therapeutic vaccine, a setting in which tailored vaccines can be useful.

Other viral vectors can include poxvirus (vaccinia), including vaccinia Ankara and canarypox; adenoviruses, including adenovirus type 5 (Ad5); rubella; sendai virus; rhabdovirus; alphaviruses; and adeno-associated viruses. Alternatively, EpiGraph vaccine antigens could be delivered as DNA, RNA or protein components of a vaccine. As this is an antigen design strategy, EpiGraph-designed vaccine antigens would be compatible with essentially any mode of vaccine antigen delivery.

In certain embodiments, vaccines designed using EpiGraph amino acid sequences have a single antigen. In certain embodiments, vaccines designed using EpiGraph amino acid sequences have sets of antigens.

In certain embodiments, the EpiGraph antigen sequences can be used in a prophylactic vaccine setting.

In certain embodiments, the EpiGraph strategy can be used to make sequences that fully optimize epitope coverage for a prophylactic vaccine. This could be one sequence, or several sequences designed to complement each other as a preventative vaccine. EpiGraph vaccines could be used in any vector, including, but not limited to, plasmids, bacterial vectors, and viral vectors.

In the EpiGraph algorithm, the natural sequences are characterized by a large graph of nodes, each node corresponding to an epitope that appears in the natural sequences. Directed edges connect two nodes when the corresponding two epitope strings are "consistent", meaning the last k−1 characters in the first string agree with the first k−1 characters in the second string (e.g., "EPTAPPAEPTAP" [SEQ ID NO: 796] and "PTAPPAEPTAPP" [SEQ ID NO: 797] are consistent k=12-mers). If two strings are consistent, then a string of length k+1 (e.g., "EPTAPPAEPTAPP") [SEQ ID NO: 798] contains both epitopes. More generally, a path through this graph of nodes and edges corresponds to a single string that contains k-mer substrings corresponding to each of the nodes in the graph. Each node is weighted according to how many sequences in the reference set exhibit a substring corresponding to that node. The EpiGraph algorithm uses a dynamic programming scheme to find the path through this full graph that maximizes the sum of these weights, and therefore provides the greatest coverage.

Certain embodiments provided include an HIV-1 vaccine comprising a vector and a population episensus antigen, or combination of optimized EpiGraph antigens designed to be used as a set. There are many different vectors that could be used for the vaccine. For example, one type of vector that can be used is a viral vector. These viral vectors can include a human cytomegalovirus (HCMV), a poxvirus, adenoviruses, rubella, sendai virus, rhabdovirus, alphavirus or adeno-associated virus. The vaccine could also be delivered as a gene encoding the EpiGraph protein, either using DNA, RNA, or included as an expressed protein or part of a protein.

In certain embodiments, EpiGraph antigen of the disclosed vaccines can be derived from the HIV-1 Gag protein. In another embodiment, the HIV-1 Gag protein has been inactivated by eliminating a myristoylation sequence in the N-terminus of the HIV-1 Gag protein. In another embodiment, the EpiGraph antigen can be derived from the HIV-1 Pol or Nef protein, or indeed any other HIV protein, including Env, Tat, Rev, Vif, or Vpu.

In certain embodiments, the population episensus antigen can be determined using the EpiGraph approach. This population episensus antigen could then be used to create a vaccine. Alternatively, EpiGraphs could be designed as a combination of sequences designed to be used as a set. HIV-1 can be split into clades based on geographic location. In one embodiment, the population episensus antigen is central to the HIV-1 B clade epidemic in the United States in the disclosed vaccines. In another embodiment, the population episensus antigen is central to the HIV-1 C clade epidemic in South Africa in the disclosed vaccines. In another embodiment, the population episensus antigen is central to the HIV-1 2-clade regional epidemic in Thailand in the disclosed vaccines. In another embodiment, the population episensus antigen is central to the HIV-1 M-group global set in the disclosed vaccines.

In some embodiments, the HIV-1 population episensus antigen comprises epitopes from Gag, Pol, Nef, Env, Tat, Rev, Vpr, Vif, or Vpu. In some embodiments, the HIV-1 population episensus antigen comprises epitopes from Gag and comprises the amino acid sequence of SEQ ID NO: 691, SEQ ID NO: 697, SEQ ID NO: 698, SEQ ID NO: 699, or SEQ ID NO: 700. In some embodiments, the HIV-1 population episensus antigen comprises epitopes from a conserved region of HIV-1. In some embodiments, the HIV-1 population episensus antigen comprises epitopes from a conserved region of Gag, Pol, or Nef. In some embodiments, the epitopes from the conserved region of Gag are epitopes from the p24 capsid protein of Gag.

In some embodiments, the HIV-1 population episensus antigen is a fusion antigen comprising two or more HIV-1 population episensus antigens. In some embodiments, the fusion antigen comprises a HIV-1 population episensus antigen comprising Gag epitopes and a HIV-1 population episensus antigen comprising Nef epitopes. In some embodiments, the fusion antigen comprises a HIV-1 population episensus antigen comprising epitopes from a conserved region of Gag and a HIV-1 population episensus antigen comprising epitopes from a conserved region of Nef. In some embodiments, the epitopes of the fusion antigen from the conserved region of Gag are epitopes from the p24 capsid protein of Gag.

In some embodiments, the HIV-1 population episensus antigen is central to the HIV-1 B clade epidemic in the United States. In some embodiments, the HIV-1 B clade population episensus antigen comprises Gag epitopes and comprises the amino acid sequence of SEQ ID NO: 730, SEQ ID NO: 732, or SEQ ID NO: 778. In some embodiments, the HIV-1 B clade population episensus antigen comprises epitopes from the p24 capsid protein of Gag and comprises the amino acid sequence of SEQ ID NO: 731, SEQ ID NO: 733, or SEQ ID NO: 779. In some embodiments, the HIV-1 B clade population episensus antigen comprises Nef epitopes and comprises the amino acid sequence of SEQ ID NO: 734 or SEQ ID NO: 736. In some embodiments, the HIV-1 B clade population episensus antigen comprises epitopes from a conserved region of Nef and comprises the amino acid sequence of SEQ ID NO: 735 or SEQ ID NO: 737. In some embodiments, the HIV-1 B clade population episensus antigen comprises Pol epitopes and comprises the amino acid sequence of SEQ ID NO: 703, SEQ ID NO: 704, SEQ ID NO: 738, or SEQ ID NO: 740. In some embodiments, the HIV-1 B clade population episensus antigen comprises epitopes from a conserved region of Pol and comprises the amino acid sequence of SEQ ID NO: 739 or SEQ ID NO: 741. In some embodiments, the HIV-1 B clade population episensus antigen is a fusion antigen comprising (1) a HIV-1 B clade population episensus antigen comprising Gag epitopes and (2) a HIV-1 B clade population episensus antigen comprising Nef epitopes, wherein the fusion antigen comprises the amino acid sequence of SEQ ID NO: 701 or SEQ ID NO: 702. In some embodiments, the HIV-1 B clade population episensus antigen is a fusion antigen comprising (1) a HIV-1 B clade population episensus antigen comprising epitopes from the p24 capsid protein of Gag and (2) a HIV-1 B clade population episensus antigen comprising epitopes from a conserved region of Nef.

In some embodiments, the HIV-1 population episensus antigen is central to the HIV-1 C clade epidemic in South Africa. In some embodiments, the HIV-1 C clade population episensus antigen comprises Gag epitopes and comprises the amino acid sequence of SEQ ID NO: 742, SEQ ID NO: 744, or SEQ ID NO: 766. In some embodiments, the HIV-1 C clade population episensus antigen comprises epitopes from the p24 capsid protein of Gag and comprises the amino acid sequence of SEQ ID NO: 743, SEQ ID NO: 745, or SEQ ID NO: 767. In some embodiments, the HIV-1 C clade population episensus antigen comprises Nef epitopes and comprises the amino acid sequence of SEQ ID NO: 746 or SEQ ID NO: 748. In some embodiments, the HIV-1 C clade population episensus antigen comprises epitopes from a conserved region of Nef and comprises the amino acid sequence of SEQ ID NO: 747 or SEQ ID NO: 749. In some embodiments, the HIV-1 C clade population episensus antigen comprises Pol epitopes and comprises the amino acid sequence of SEQ ID NO: 750 or SEQ ID NO: 752. In some embodiments, the HIV-1 C clade population episensus antigen comprises epitopes from a conserved region of Pol and comprises the amino acid sequence of SEQ ID NO: 751 or SEQ ID NO: 753. In some embodiments, the HIV-1 C clade population episensus antigen is a fusion antigen comprising (1) a HIV-1 C clade population episensus antigen comprising Gag epitopes and (2) a HIV-1 C clade population episensus antigen comprising Nef epitopes. In some embodiments, the HIV-1 C clade population episensus antigen is a fusion antigen comprising (1) a HIV-1 C clade population episensus antigen comprising epitopes from the p24 capsid protein of Gag and (2) a HIV-1 C clade population episensus antigen comprising epitopes from a conserved region of Nef.

In some embodiments, the HIV-1 population episensus antigen is central to the HIV-1 2-clade regional epidemic in Thailand. In some embodiments, the HIV-1 2-clade population episensus antigen comprises Gag epitopes. In some embodiments, the HIV-1 2-clade population episensus antigen comprises epitopes from the p24 capsid protein of Gag. In some embodiments, the HIV-1 2-clade population episensus antigen comprises Nef epitopes. In some embodiments, the HIV-1 2-clade population episensus antigen comprises epitopes from a conserved region of Nef. In some embodiments, the HIV-1 2-clade population episensus antigen comprises Pol epitopes. In some embodiments, the HIV-1 2-clade population episensus antigen comprises epitopes from a conserved region of Pol. In some embodiments, the HIV-1 2-clade population episensus antigen is a fusion antigen comprising (1) a HIV-1 2-clade population episensus antigen comprising Gag epitopes and (2) a HIV-1 2-clade population episensus antigen comprising Nef epitopes. In some embodiments, the HIV-1 2-clade population episensus antigen is a fusion antigen comprising (1) a HIV-1 2-clade population episensus antigen comprising epitopes from the p24 capsid protein of Gag and (2) a HIV-1

2-clade population episensus antigen comprising epitopes from a conserved region of Nef.

In some embodiments, the HIV-1 population episensus antigen is central to the HIV-1 M-group global set. In some embodiments, the HIV-1 M-group population episensus antigen comprises Gag epitopes and comprises the amino acid sequence of SEQ ID NO: 718, SEQ ID NO: 720, or SEQ ID NO: 754. In some embodiments, the HIV-1 M-group population episensus antigen comprises epitopes from the p24 capsid protein of Gag and comprises the amino acid sequence of SEQ ID NO: 719, SEQ ID NO: 721, or SEQ ID NO: 755. In some embodiments, the HIV-1 M-group population episensus antigen comprises Nef epitopes and comprises the amino acid sequence of SEQ ID NO: 722 or SEQ ID NO: 724. In some embodiments, the HIV-1 M-group population episensus antigen comprises epitopes from a conserved region of Nef and comprises the amino acid sequence of SEQ ID NO: 723 or SEQ ID NO: 725. In some embodiments, the HIV-1 M-group population episensus antigen is a fusion antigen comprising (1) a HIV-1 M-group population episensus antigen comprising Gag epitopes and (2) a HIV-1 M-group population episensus antigen comprising Nef epitopes, wherein the fusion antigen comprises the amino acid sequence of SEQ ID NO: 705 or SEQ ID NO: 707. In some embodiments, the HIV-1 M-group population episensus antigen is a fusion antigen comprising (1) a HIV-1 M-group population episensus antigen comprising epitopes from the p24 capsid protein of Gag and (2) a HIV-1 M-group population episensus antigen comprising epitopes from a conserved region of Nef, wherein the fusion antigen comprises the amino acid sequence of SEQ ID NO: 706 or SEQ ID NO: 708. In some embodiments, the HIV-1 M-group population episensus antigen comprises Pol epitopes and comprises the amino acid sequence of SEQ ID NO: 709, SEQ ID NO: 711, SEQ ID NO: 726, or SEQ ID NO: 728. In some embodiments, the HIV-1 M-group population episensus antigen comprises epitopes from a conserved region of Pol and comprises the amino acid sequence of SEQ ID NO: 710, SEQ ID NO: 712, SEQ ID NO: 727, or SEQ ID NO: 729.

In certain embodiments, the disclosed vaccines can further comprise a HCMV vector comprising a HCMV backbone and a tailored antigen selected to be a best match natural HIV-1 strain. In another embodiment, the disclosed vaccines can further comprise a HCMV vector comprising a HCMV backbone and a tailored antigen selected to be a best match different HIV-1 strain.

In some embodiments, the HIV-1 tailored antigen comprises epitopes from Gag, Pol, Nef, Env, Tat, Rev, Vpr, Vif, or Vpu. In some embodiments, the tailored antigen comprises a sequence selected from: SEQ ID NOs. 692-696; SEQ ID NOs. 756-765; SEQ ID NOs. 769-777; or SEQ ID NOs. 780-789.

In some embodiments, the HIV-1 tailored antigen comprises epitopes from Gag and comprises the amino acid sequence of SEQ ID NO: 692, SEQ ID NO: 693, SEQ ID NO: 694, SEQ ID NO: 695, or SEQ ID NO: 696.

In some embodiments, the HIV-1 tailored antigen is central to the HIV-1 M-group global set. In some embodiments, the HIV-1 M-group tailored antigen comprises Gag epitopes and comprises an amino acid sequence selected from the group consisting of: SEQ ID NOs: 756-765. In some embodiments, the HIV-1 M-group tailored antigen comprises epitopes from the p24 capsid protein of Gag and comprises the amino acid sequence of SEQ ID NO: 757, SEQ ID NO: 759, SEQ ID NO: 761, SEQ ID NO: 763, or SEQ ID NO: 765.

In some embodiments, the HIV-1 tailored antigen is central to the HIV-1 C clade epidemic in South Africa. In some embodiments, the HIV-1 C clade tailored antigen comprises Gag epitopes and comprises an amino acid sequence selected from the group consisting of: SEQ ID NOs: 768-777. In some embodiments, the HIV-1 C clade tailored antigen comprises epitopes from the p24 capsid protein of Gag and comprises the amino acid sequence of SEQ ID NO: 769, SEQ ID NO: 771, SEQ ID NO: 773, SEQ ID NO: 775, or SEQ ID NO: 777.

In some embodiments, the HIV-1 tailored antigen is central to the HIV-1 B clade epidemic in the United States. In some embodiments, the HIV-1 B clade tailored antigen comprises Gag epitopes and comprises an amino acid sequence selected from the group consisting of: SEQ ID NOs: 780-789. In some embodiments, the HIV-1 B clade tailored antigen comprises epitopes from the p24 capsid protein of Gag and comprises the amino acid sequence of SEQ ID NO: 781, SEQ ID NO: 783, SEQ ID NO: 785, SEQ ID NO: 787, or SEQ ID NO: 789.

In certain embodiments, methods of treating HIV-1 in a subject comprising administering an effective amount of one of the disclosed vaccines to the subject in need thereof is provided. In another embodiment, the selecting vaccine antigens to optimally cover the diversity within a geographical area uses a vaccine antigen sequence generated using the EpiGraph method of antigen sequence selection.

Embodiments of the present invention include methods of treating an HIV-1 infection in a subject comprising administering an effective amount of any of these disclosed vaccines to the subject in need thereof.

Embodiments of the present invention also include methods of inducing an effector memory T cell response comprising determining one or more EpiGraph sequences, generating a vaccine comprising the one or more EpiGraph amino sequences and a vector; and, administering the vaccine to a subject in need thereof. In another embodiment, methods are provided of inducing an effector memory T cell response wherein the one or more EpiGraph amino sequences comprises SEQ ID NO: 697, SEQ ID NO: 698, SEQ ID NO: 699, or SEQ ID NO: 700. This vaccine can be a prophylactic or therapeutic vaccine.

Recent breakthroughs in HIV vaccine research include the concept of an effector memory T cell (TEM)-inducing vaccine to prevent HIV infection. Unlike central memory T cells (TCM) induced by traditional vaccine approaches, TEM are persistently maintained in lymphoid tissues and extralymphoid effector sites and are immediately ready to mediate anti-viral effector function, thus providing a constant immune shield at the portals of viral entry and sites of viral reactivation. The most qualified vector system to induce and indefinitely maintain TEM is derived from CMV. Presumably due to continuous, low-level reactivation and/or gene expression in persistently infected cells, CMV maintains just the right amount of persistent, low level immune stimulation required for TEM maintenance without triggering T cell exhaustion.

In certain embodiments, the tailored antigen cocktail can be used in a therapeutic vaccine setting. For example, the tailored vaccine can use a k-means clustering strategy to a defined set of 6-10 sequences that provide very good coverage of epitopes in a population of people that are infected with a highly variable pathogen, such as HIV. The virus infecting a subject can be sequenced and 2 or 3 tailored vaccines will be delivered that best cover the infecting virus.

Epitope coverage will be optimized while epitope mismatches will be will be minimized between the vaccine and the infecting strain.

Certain embodiments provided include an HIV-1 vaccine comprising a HCMV backbone vector, which lacks certain CMV gene regions, and a population episensus antigen. In certain embodiments, the HCMV backbone can lack the UL131A-128 gene region. Certain embodiments can also include deletion of the tegument protein pp71 (UL82) gene. (U.S. Patent Application Publication Nos. 2014-0141038; 2008-0199493; 2013-0142823: and International Application Publication No. WO/2014/138209).

In certain embodiments, the present disclosure provides vaccines which can comprise a second tailored antigen sequence. In certain embodiments, the vaccines can comprise a second, a third, or more tailored antigen sequences. The episensus antigen can comprise the amino acid sequence of SEQ ID NO: 691. The tailored antigen can comprise the amino acid sequence of SEQ ID NO: 692, SEQ ID NO: 693, SEQ ID NO: 694, SEQ ID NO: 695 or SEQ ID NO: 696. In one embodiment, the first tailored antigen sequence and the second tailored antigen sequence comprise two of the amino acid sequences of SEQ ID NO: 692, SEQ ID NO: 693, SEQ ID NO: 694, SEQ ID NO: 695 and SEQ ID NO: 696. In another embodiment, the first tailored antigen sequence, the second tailored antigen sequence and the third tailored antigen sequence comprises three of the amino acid sequences of SEQ ID NO: 692, SEQ ID NO: 693, SEQ ID NO: 694, SEQ ID NO: 695 and SEQ ID NO: 696.

Also provided are tailored antigen sequences that can comprise SEQ ID NO: 692, SEQ ID NO: 693, SEQ ID NO: 694, SEQ ID NO: 695 or SEQ ID NO: 696.

In certain embodiments, the disclosed vaccines can further comprise a HCMV vector comprising a HCMV backbone and a tailored antigen selected to be a best match natural HIV-1 strain. In another embodiment, the disclosed vaccines can further comprise a HCMV vector comprising a HCMV backbone and a tailored antigen selected to be a best match different (and distant) HIV-1 strain.

In certain embodiments, the episensus antigen and the tailored antigen of the disclosed vaccines can be derived from the HIV-1 Gag protein. In another embodiment, the HIV-1 Gag protein has been inactivated by eliminating a myristoylation sequence in the N-terminus of the HIV-1 Gag protein. In another embodiment, the episensus antigen and the tailored antigen can be derived from the HIV-1 Pol or Nef protein.

In certain embodiments, methods of treating HIV-1 in a subject comprising administering an effective amount of one of the disclosed vaccines to the subject in need thereof is provided. In another embodiment, methods of designing and producing an HIV-1 vaccine for a subject comprising sequencing HIV-1 viruses in an individual, selecting vaccine antigens designed to optimally cover the diversity within a geographic area, and, inserting the vaccine antigens into a vector are provided.

Certain embodiments include methods of treating an HIV-1 infection in a subject comprising administering an effective amount of any of these disclosed vaccines to the subject in need thereof.

The following examples are provided to describe the embodiments described herein with greater detail. They are intended to illustrate, not to limit, the embodiments.

All documents, patent, and patent applications cited herein are hereby incorporated by reference, and may be employed in the practice of the invention.

EXAMPLES

Example 1: Graphical Model for Optimal Epitope Coverage of Aligned Sequences The existence of a set $S=\{s_1, s_2, \ldots, s_N\}$ of N aligned sequences was presumed. Each sequence is a string of alphabetic characters (corresponding to the twenty amino acids, possibly in addition to a few special characters corresponding to gaps, unknowns, and such). Since the sequences are aligned, all have the same length T, and the positions $t=1 \ldots T$ are well-defined from sequence to sequence; $s_n[t]$ will be written as the t'th character in the n'th sequence. It is useful to introduce the notation s[t: u] for the subsequence of s that begins at position t and ends at position u.

A potential epitope was defined as a short sequence of k characters, typically 8 to 12. Epitopes of interest are subsequences of the sequences in S. Indeed, a sequence s can be thought of as a list of epitopes: $e_1, \ldots, e_{T-k+1}$, with $e_t=s[t:t+k-1]$. Note, however, that for a list of epitopes to be associated with a sequence, it is necessary that the epitopes be consistent. Specifically, it is required for any adjacent pair $e_t$ and $e_{t+1}$ that the last k−1 characters of $e_t$ agree with the first k−1 characters of $e_{t+1}$; that is: $e_t[2: k]=e_{t+1}[1: k-1]$.

For each epitope e, a frequency f(e) can be associated which counts the fraction of sequences in S for which the epitope appears.

For the general cocktail problem, a set of artificial sequences $Q=\{q_1, \ldots, q_M\}$ is sought whose epitopes have useful properties. Let $E_Q$ be the set of all epitopes that appear in Q; that is:

$$E_Q=\{e|e=q_m[t:t+k-1] \text{ for some choice of } m,t\}.$$

In particular, those epitopes were designed to cover as much of the sequence set S as possible. The goal was to maximize the coverage score $$\Sigma f(e) \text{ where the sum is over } e\in E_Q$$

With M<N, and typically M«N, all the epitopes cannot in general be covered.

For the aligned sequence problem, some simplifications can be made. In this case, each position in the alignment was treated as a different (but not independent) problem. The frequency function now depended on position: f(t, e) was the number of sequences in S for which e is the k-mer subsequence that began at position t; thus, $$f(t,e)=\Sigma I(e=s_n[t:t+k-1])$$

where I is the indicator function: it is one if its argument is true, and is zero otherwise. The set $E_Q$ can also be partitioned according to position in sequences q. Thus:

$$E_Q[t]=\{e|e=q_m[t:t+k-1] \text{ for some } m\}$$

This enables a production of a coverage measure for each position $c[t]=\Sigma_{e\in EQ[t]}f(t,e)$, from which an overall coverage is given by $c=\Sigma_t c[t]$.

For the trivial special case k=1, the epitopes were just the amino acid characters. But even though the problem was trivial to solve, the solution was still useful. For M=1, the best solution is given by the consensus sequence, with $q_1[t]$ chosen to be the amino acid that is most common at position t. For M=2, one can optimize the coverage by taking $q_2[t]$ to be the second-most-common amino acid at position t. And so on for larger M.

For k>1, the problem becomes nontrivial because the epitopes overlap, and so each c[t] can no longer be optimized independently. The M=1 case was called the "episensus" problem because it is like the consensus, except that it is a consensus of epitopes that was sought.

In one example, the consensus and the k=3 episensus disagree: The consensus used the most popular letter in each position. The episensus used the most popular "epitope", where we call a potential epitope a string of 3 characters. Table 1 expands this example to illustrate overlapping epitope strings.

TABLE 1

Shown are six sequences and their associated k = 3 epitopes. The bottom line shows the consensus sequences (formed from the most common character at each position) and the most common epitopes at each position. But these epitopes (in particular, EFG and CHS) are inconsistent with each other, so they cannot be combined into a single episensus solution. In this case, the best episensus score is given (though not uniquely) by the sequence ARCHSLM [SEQ ID NO: 794], which covers 1 + 1 + 2 + 2 + 3 = 9 out of 30 possible epitopes in the sequences. The consensus, ARCGSLM [SEQ ID NO: 799], covers 1 + 1 + 1 + 1 + 3 = 7. Note that an upper bound on this score can be obtained from the frequency of the most popular epitopes at each position: in this case, that gives 2 + 2 + 2 + 2 + 3 = 11.

|  | Sequences |  |  | Toy Epitopes |  |  |
| --- | --- | --- | --- | --- | --- | --- |
| [SEQ ID NO: 800] | ARCGSPM | ARC | RCG | CGS | GSP | SPM |
| [SEQ ID NO: 801] | ARYGSNM | ARY | RYG | YGS | GSN | SNM |
| [SEQ ID NO: 802] | AYCHSLM | AYC | YCH | CHS | HSL | SLM |
| [SEQ ID NO: 803] | YRCHSLM | YRC | RCH | CHS | HSL | SLM |
| [SEQ ID NO: 804] | DEFGSLM | DEF | EFG | FGS | GSL | SLM |
| [SEQ ID NO: 805] | DEFGKLM | DEF | EFG | FGK | TKL | KLM |

Solving the Episensus Problem.

Figure 1B:
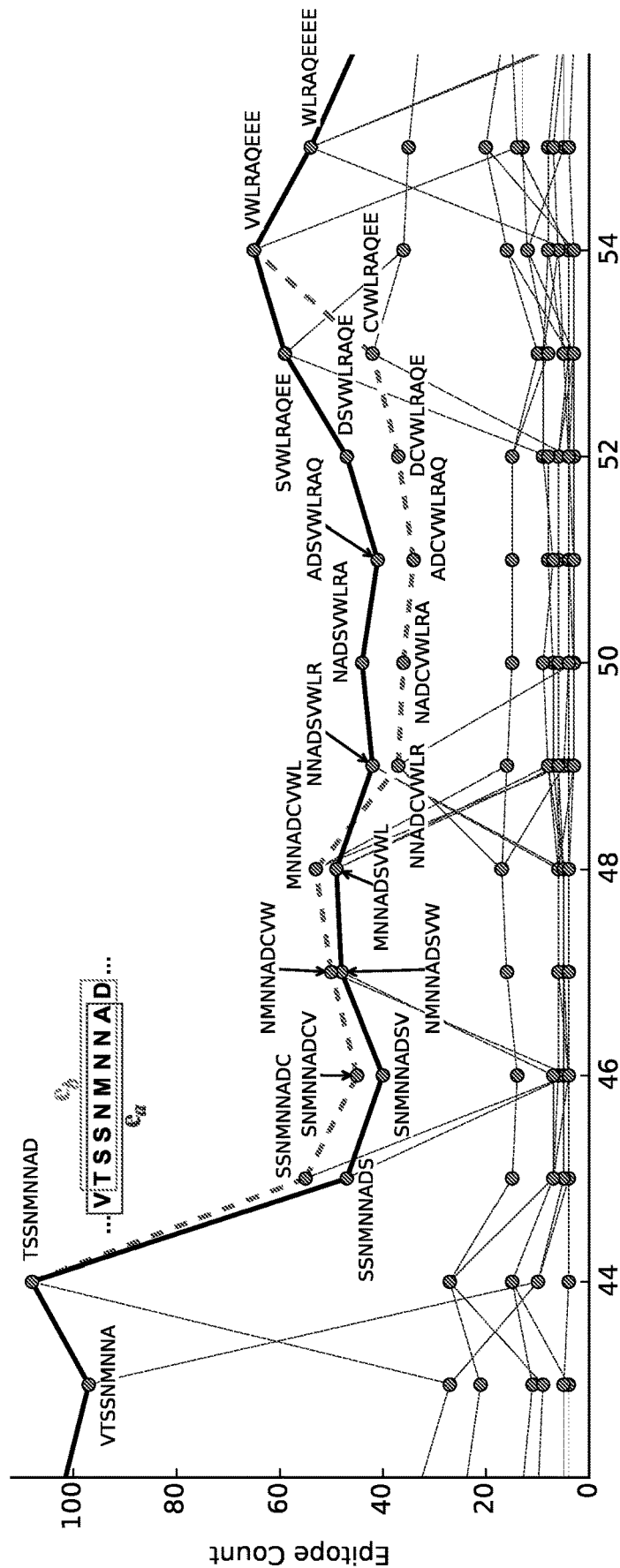
FIG. 1B represents the inset from FIG. 1A. Nodes are grey dots, and represent each k-mer variant, with k=9. The edges are horizontal lines that connect epitopes whose sequences overlap by k−1 amino acids, as shown for the first two epitopes=VTSSNMNNA [SEQ ID NO: 790], $e_b$=TSSNMNNAD [SEQ ID NO: 791]) in the upper left. Although the topological properties of the graph do not depend on the node positions, this plot uses the vertical axis to indicate epitope frequency in the target sequence set, y=f(e), for each node. The horizontal position x(e)=1+ $\max_{e' \in P(e)} x(e')$, where P(e) is the set of predecessors of e, gives this plot the property that all directed edges connect from left to right. The ideal path through this graph keeps as much as possible to the largest y-values. The inset shows two paths through the nodes. The solid black line is the optimal path, and corresponds to the sequence TSSNMN-NADSVWLRAQEEE [SEQ ID NO: 792] while the dashed line corresponds to TSSNMNNADCVWLRAQEEE [SEQ ID NO: 793]. The dashed line achieves higher f(e) values on 4 nodes, but the solid line has higher f(e) for 5 nodes, and $\Sigma f(e)$ is higher. Note there is no path that includes the highest-valued nodes for all values of x.

The M=1 case was addressed first, in which a single sequence q whose epitopes optimally cover the epitopes in an unaligned sequence list S was sought. The EpiGraph algorithm under appropriate assumptions achieves the optimal solution. In the comparisons, the consensus algorithm was also considered (very simple and fast) and the optimization by genetic algorithm (very slow) as described in (Fisher, Nat Med. 2007 January; 13(1):100-6, incorporated herein by reference). The EpiGraph algorithm is illustrated in FIGS. 1A and 1B.

Later the more general cocktail of vaccines problem was considered, with M>1 and shown how the episensus algorithm was modified for this more general problem.

Figure 2:
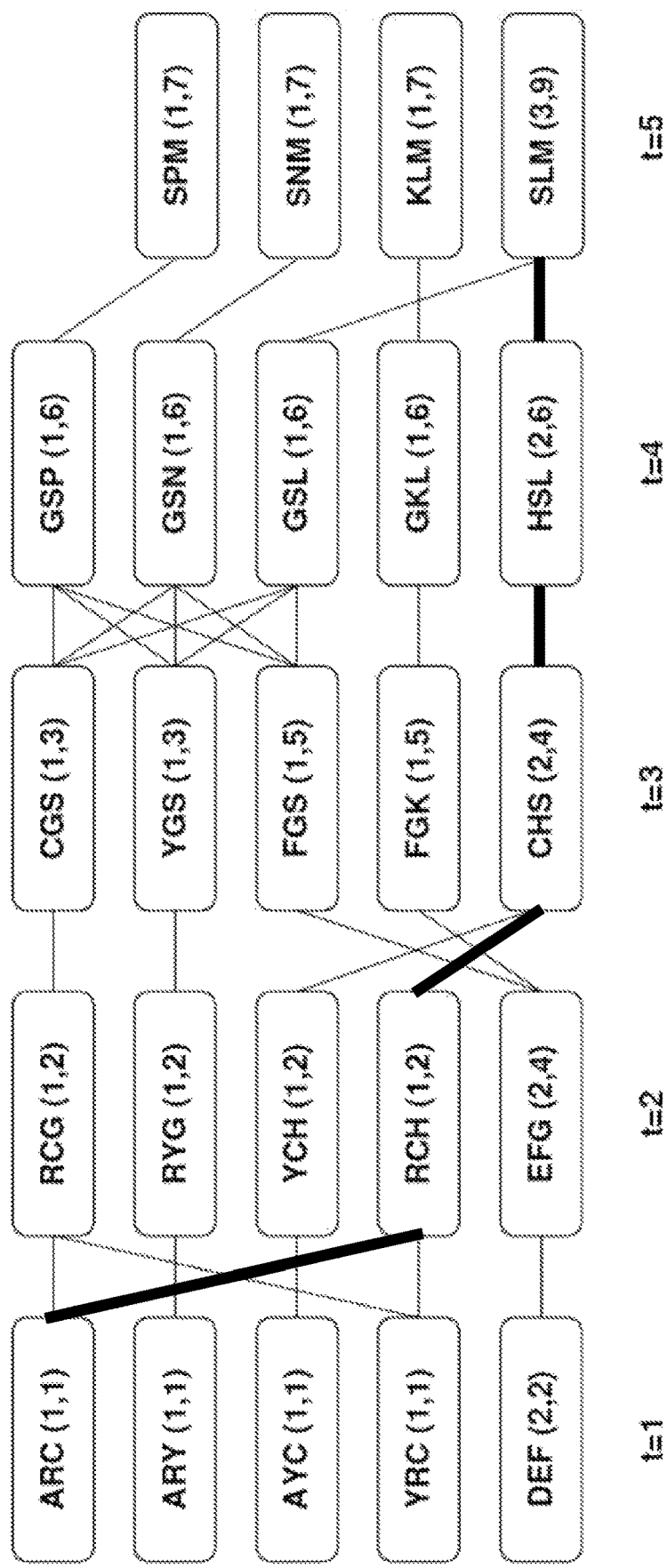
FIG. 2 shows nodes of an epitope graph showing the epitope k-character string, and the frequency (f) that the epitope is observed at that position in the aligned sequence set, and the cumulative best score S of consistent paths that end in that node. The nodes are arranged in columns with each column corresponding to the position t associated with the epitope. The lines connecting these nodes correspond to adjacent epitopes that are consistent. The aim is to find a consistent path through this graph that maximizes the sum of the frequency values in each node. The thicker lines show one path that leads to an optimal total score.

FIG. 2 shows nodes of an epitope graph, where each node includes the epitope k-character string, and the frequency (f) that the epitope is observed at that position in the aligned sequence set, and the cumulative best score S of consistent paths that end on that node. The nodes were arranged in columns with each column corresponding to the position t associated with the epitope. The lines connecting these nodes correspond to adjacent epitopes that were consistent. The aim is to and a consistent path through this graph that maximized the sum of the frequency values in each node.

The thicker lines in FIG. 2 show one path that leads to an optimal total score. There will always be at least one such path, but it may not be unique.

The cumulative score S(t, e) was defined as the highest score achievable starting at t=1 and finishing at the epitope e at position t. It was observed that $S(t=1, e)=f(e)$ and that values for $t>1$ can be computed recursively:

$$S(t,e)=f(e)+\max_{e'}S(t-1,e'), \text{with } e' \in E(t-1,e)$$

where E(t−1, e) is the set of epitopes at position t−1 that are consistent with e, which is at position t. Having computed this cumulative score for all the epitopes, the total score was found for the best path as the maximum score on the last column: $S_{max}=\max_e S(T-k+1, e)$. Furthermore, it can be worked backwards from this maximum to find the optimal path:

$$e^*_{T-k+1}=\operatorname{argmax}_e S(T-k+1,e)$$

$$e^*_{t-1}=\operatorname{argmax}_{e'}S(t-1,e') \text{ with } e' \in E(t-1,e^*_t)$$

The sequence $e^*_1, e^*_2, \ldots, e^*_{T-k}$ defined the highest-scoring consistent sequence of epitopes. The episensus string q is obtained by taking the first character from each epitope: $q[t]=e_t^*[1]$, and finishing off with the last epitope: $q[T-k:T]=e^*_{T-k}[1:k]$.

The argmax operator may not have a unique value; if it does not, then there will be multiple solutions to the episensus problem, all of which are optimal in the sense of coverage.

Gaps.

In order to align sequences, insertions and deletions have to be dealt with, and this introduces gaps into the aligned sequences. For example, the sequences ARCCDEGH [SEQ ID NO: 806] and ARCDEFGH [SEQ ID NO: 807] were better aligned as ARCCDE-GH [SEQ ID NO: 808] and ARC-DEFGH [SEQ ID NO: 809]. Placeholder Epitopes were Developed to Deal with these Gaps in the EpiGraph Algorithm.

Placeholder Epitopes:

The k=3 epitopes were ARC, RCC, CCD, CDE, DEG, EGH and ARC, RCD, CDE, DEF, EFG, FGH respectively; but when epitopes were aligned by first column, gaps need to be introduced in that list: ARC, RCC, CCD, CDE, DEG, EGH, -GH and ARC, RCD, CDE, -DE, DEF, EFG, FGH. The strings -GH and -DE were placeholder epitopes. Placeholders are not counted in the covering function; that is: f(t; -XY)=0. But they were still useful because they can be used to define consistency of adjacent epitopes.

For ungapped sequences, two adjacent epitopes were considered consistent if the last k−1 characters of the first epitope agree with the first k−1 characters of the second epitope. Thus ARC and RCD are consistent, but RCC and CDE are not. When gaps are introduced, then a pair is consistent if the second epitope begins with a gap character is considered, and the remaining k−1 characters match the last k−1 characters of the last epitope. Thus, CDE and -DE are consistent.

For the drop-in-place algorithm, a "substrate" sequence that is generally taken to be the consensus sequence was used. Then, all the epitopes at all the positions were taken and sorted according to how often they appear. Starting from the least frequent epitope, each epitope was dropped onto the substrate by replacing the characters in the substrate at the positions [t:t+k−1] with the characters in the epitope. When the most frequently occurring epitope was dropped onto the substrate, a string was used as the episensus solution q. Since the most frequent epitopes overwrite the rarer epitopes, higher epitope coverage was achieved. And since a single sequence q is always updated, the final solution will be composed of consistent epitopes.

The algorithm may not be fully deterministic because some epitopes might have identical frequencies, and if their positions are overlapping, then the final result may depend on what order they are dropped. On implementation, the order that the sort algorithm gives is taken, but there is an opportunity to randomize those orders and to make multiple runs of the algorithm, with some runs possibly giving higher scores.

Heuristic "Drop-in-Place" Algorithm.

In this algorithm, a "substrate" sequence was taken to be the consensus sequence, but the choice of substrate rarely makes any difference. All the epitopes at all the positions were taken and sorted according to how often they appear. Starting from the least frequent epitope.

Each epitope was "dropped" onto the substrate by replacing the characters in the substrate at the positions [t:t+k−1] with the characters in the epitope. When the most frequently occurring epitope was finally dropped onto the substrate, there was a string that was used as episensus solution q. Since the most frequent epitopes overwrite the rarer epitopes, a high epitope coverage was achieved. Since a single sequence q was always being updated, the final solution was composed of consistent epitopes.

The algorithm may not be fully deterministic because some epitopes might have identical frequencies, and if their positions are overlapping, then the final result may depend on what order they are dropped. In implementation, the order that the sort algorithm gives is taken, but there is an opportunity to randomize those orders and to make multiple runs of the algorithm, with some runs possibly giving higher scores. The utility of this randomized multiple-run approach has not been investigated.

Figure 3:
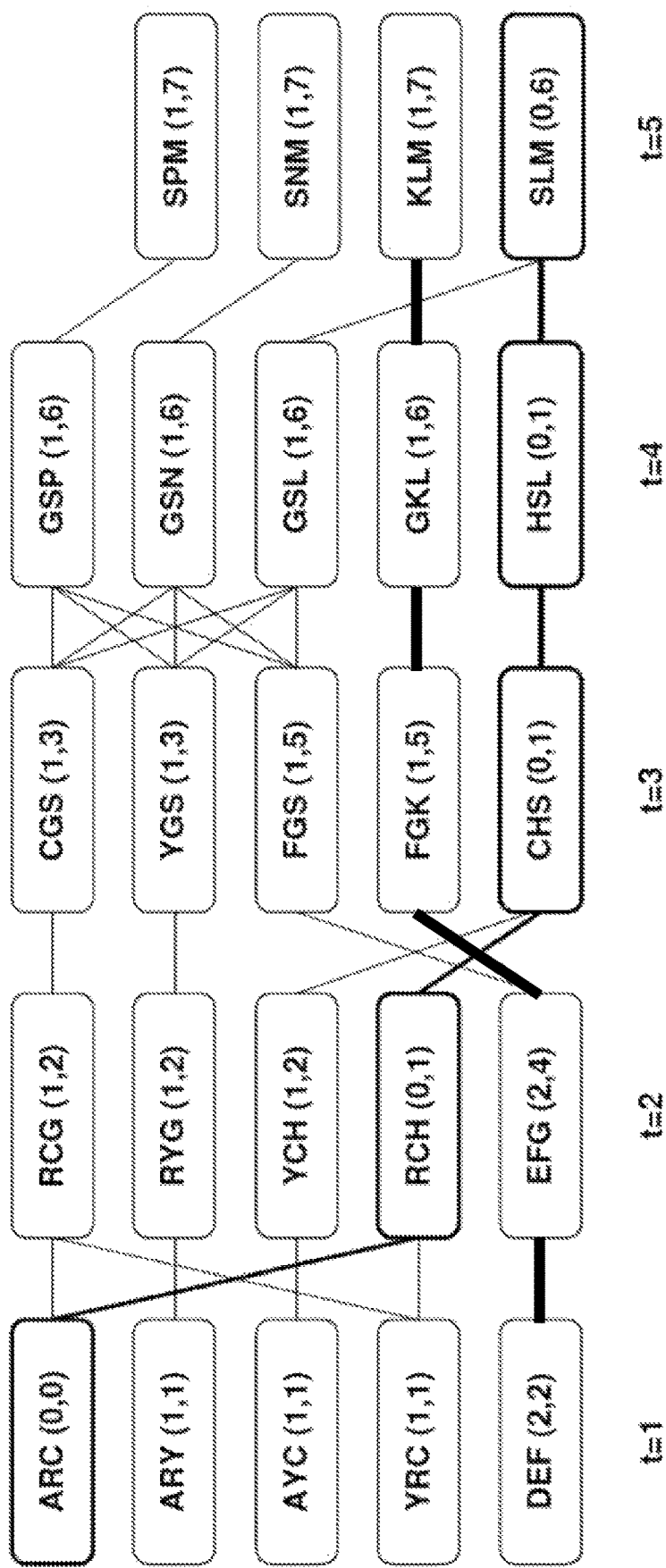
FIG. 3 shows that nodes from the initial solution (given by q1=ARCHSLM [SEQ ID NO: 794] as shown in FIG. 2 have their frequency values set to zero, and the cumulative scores S(t; e) are recomputed based on these new frequency nodes. This leads to an optimal solution to this complementary coverage problem: q2=DEFGKLM [SEQ ID NO: 795]. The thicker lines show one path that leads to an optimal total score.

The solution only depends on the most frequent epitopes at each position, so for the example in Table 1, it will be a consistent combination of DEF, EFG, CHS, HSL, SLM. If they are dropped in that order (first four have frequency 2, last one has frequency 3), DECHSLM [SEQ ID NO: 810] is obtained for which the score 0+0+2+2+3=7 beats the consensus but is less than optimal. If they were dropped in the order HSL, CHS, EFG, DEF, SLM, DEFGSLM [SEQ ID NO: 804] would be obtained with a score of 2+2+1+1+3=9, which is the optimal score for this example. These two solutions are illustrated in FIG. 3.

The Aligned Cocktail of Vaccines (M>1) Problem.

In the original mosaic solution using genetic algorithm optimization, all M of the mosaic sequences are optimized at the same time.

Sequential Solutions.

One way to extend the M=1 episensus solutions to the M>1 problem is to modify the algorithms for optimizing total coverage to optimize complementary coverage. That is: given an episensus solution $q_1$, find $q_2$ that covers as many as possible of the remaining epitopes, not covered by $q_1$.

Iterative Refinement of Sequential Solutions.

Given initial solutions $q_1, q_2, \ldots, q_M$, a new estimate for $q_1$ can be recomputed. This is done by starting with the original frequency values for each of the epitopes, but setting to zero those epitopes that are covered by $q_2, \ldots, q_M$. The optimization of this complementary coverage problem leads to a new $q_1$. One can loop through all of the initial solutions this way, each time optimizing the complementary coverage.

Off-by-One Scoring.

The analysis shown so far gives credit to coverage only if an epitope in a sequence s is exactly matched by an epitope in a sequence q. But, particularly for longer epitopes, e.g., k=12, an epitope in a sequence may still be effective if it is an approximate match. For instance, agreement in 11 out of 12 characters may constitute satisfactory coverage.

Results.

These algorithms were compared using a dataset of 690 sequences.

Figure 4:
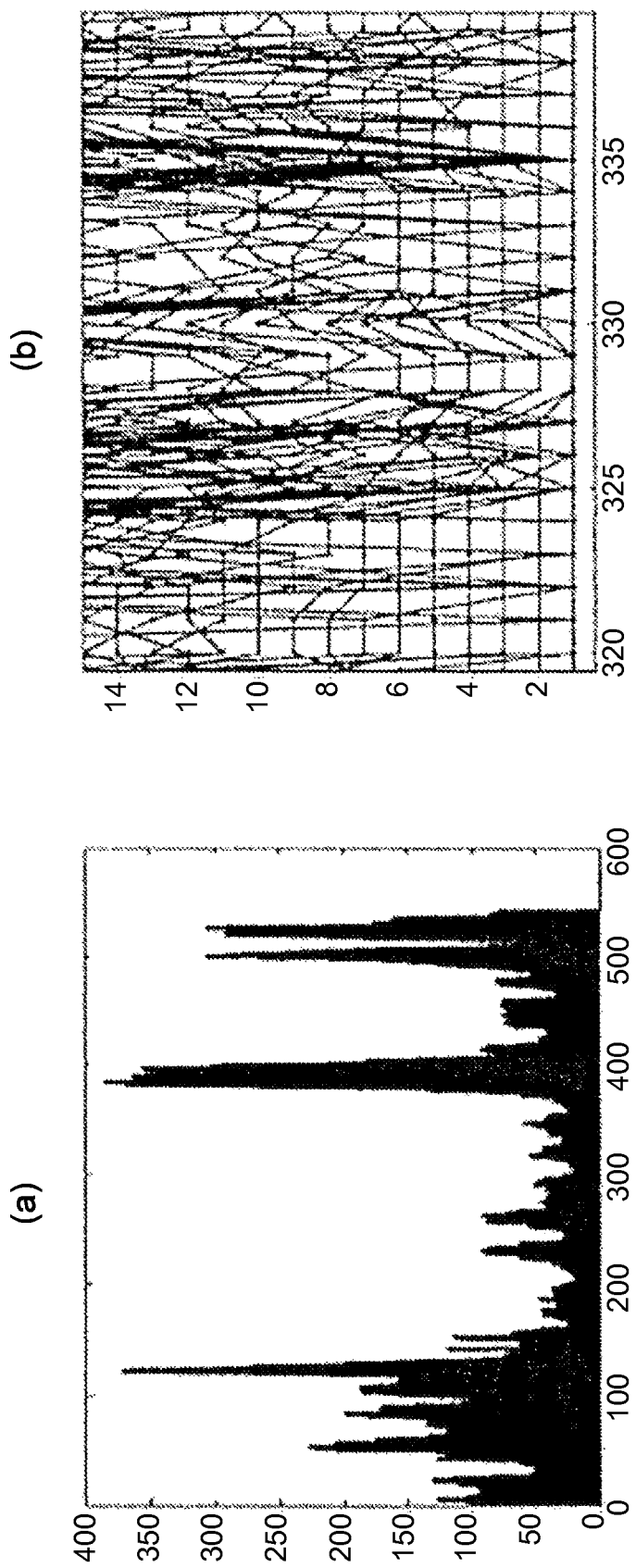
FIGS. 4A-B show the epitope graph associated with a set of 690 US B-clade Gag protein sequences [SEQ ID NOs. 1-690], each aligned to 556 positions. The horizontal axis is the position t, and the columns of nodes indicate the different epitopes at each position. The nodes are arranged so that the most frequent at each position are at the bottom of each column. The full graph is shown in FIG. 4A; a close-up inset of the same graph is shown in FIG. 4B.

FIG. 4 illustrates what the graph looks like for such a large dataset. FIG. 4 shows a graph associated with a dataset of 690 US B-clade Gag protein sequences (SEQ ID NOs. 1-690), each aligned to 556 positions. Results are shown in Table 2. Horizontal axis is the position t, and the columns of nodes indicate the different epitopes at each position. The nodes were arranged so that the most frequent are at the bottom. The nodes and edges (indicating consistency of adjacent nodes) are shown. The full graph is shown in (a); a close-up inset of the same graph is shown in (b).

Table 2 shows a comparison of coverage scores; this is fraction of the epitopes (k=12) in the sequences S that are covered (by exact match) by the epitopes in the vaccine sequences Q={$q_1, \ldots, q_M$}.

TABLE 2

| Algorithm | Episensus (M = 1) | M = 2 | M = 3 | M = 6 |
|---|---|---|---|---|
| Consensus | 0.5070 | — | — | — |
| Genetic Algorithm | 0.5072 | 0.6098 | 0.6643 | 0.7308 |

Figure 5:
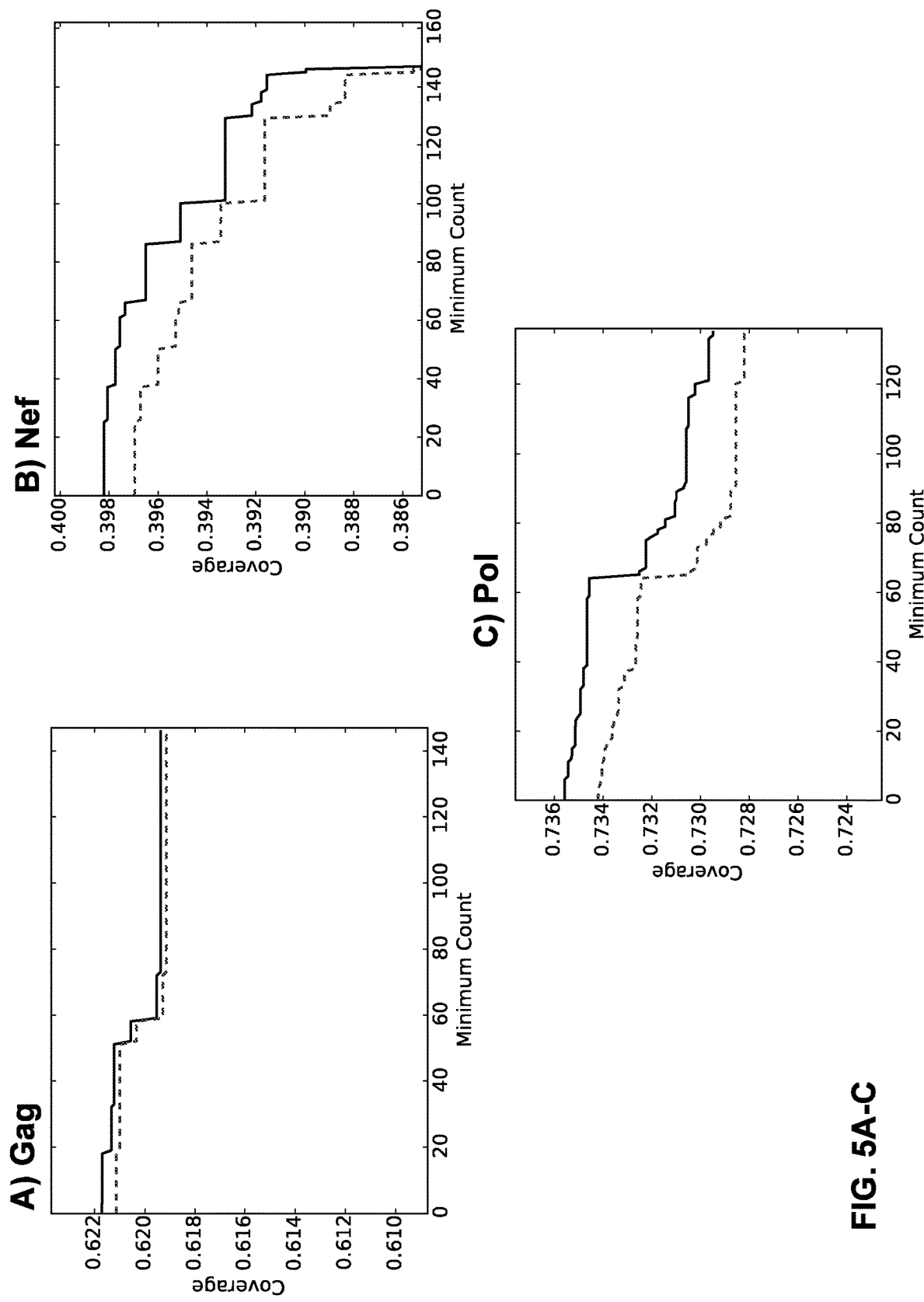
FIGS. 5A-C show that excluding rare variants decreases the coverage, but only slightly for Gag (FIG. 5A), Nef (FIG. 5B), and Pol (FIG. 5C). Coverage of polyvalent (m=2) solutions are shown as a function of minimum count $f_o$ (i.e., the population frequency of the rarest epitope in the vaccine). Dashed lines correspond to coverage given by the direct sequential algorithm; the black solid lines are based on the best solutions after 100 random restarts. The vertical axis, in all three plots, is restricted to a range of 0.015.

For the global EpiGraph solutions, single best EpiGraph sequences were determined based on the M group, B clade and C clade database sequences (including upto circa 2015), as well as the complementary $2^{nd}$ EpiGraph sequence for a bivalent vaccine, for Gag, Pol, and Nef A novel advantage of the EpiGraph code over Mosaic design is that it allows the deliberate exclusion of rare epitopes, a feature included in the design of the new sequences, see figure below for an example of the impact of excluding rare variants from the M group. FIG. 5A-C illustrates the final values of EpiGraph and Tailored vaccines that were used.

Example 2: Graphical Model for Optimal Epitope Coverage of Unaligned Sequences

A set S={$s_1, s_2, \ldots, s_N$} of N unaligned protein sequences is taken to characterize the variability of a virus over a target population (e.g., a phylogenetic clade, a country, or global). A potential epitope is a subsequence of k amino acids (typically k=9). Each potential epitope, e, is assigned an integer frequency f(e) corresponding to the number of sequences in S in which e appears. The monovalent problem is to design a single artificial sequence q that resembles a natural protein but optimally covers the potential epitopes in the population S. Writing E(q) as the set of epitopes that appear in q, our measure of coverage is $$\text{Coverage}(q) = \Sigma_{e \in E(q)} f(e) / \Sigma_{e \in E(s)} f(e)$$

The numerator is the sum of the frequencies of epitopes that appear in q, and the denominator normalizes by the sum over all epitopes that appear in any of the sequences in S. This formulation can be expressed as a directed graph. Each node in the graph corresponds to a distinct epitope e, and a directed edge connects two length-k epitopes ($e_a$; $e_b$) if those epitopes overlap by k−1 characters. A path through the graph is a sequence of nodes $e_1, e_2, \ldots, e_L$, with an edge from $e_i$ to $e_{i+1}$ for i=1, ..., L−1. Such a path corresponds to a sequence of L+k−1 characters, which is the artificial antigen q.

If this directed graph has no cycles, then EpiGraph finds a path through the graph that rigorously maximizes coverage, providing the optimal solution. Furthermore, this optimization is done with computational effort that scales only linearly with the size (as measured in nodes and edges) of the graph. In practice the directed graph created from S may not be acyclic, though it is often very nearly so, especially for larger values of k. For this case, the graph was "de-cycled," by iteratively identifying cycles and then removing low-value edges until no cycles remain.

A polyvalent "cocktail" of m>1 antigens can be created by running EpiGraph sequentially, and optimizing complementary epitope coverage. This is achieved by treating the epitopes e that were included in the first antigens as if their frequencies were zero, and then running Epigraph on these modified frequencies. If any of the epitopes in the first antigens are required to complete a path (and generate a complete protein), they will still be available, but they will be disfavored, since they no longer contribute to the coverage score. This sequential solution can be improved using iterative refinement.

Example 3: Tailored Therapeutic Vaccines

While it is not feasible to build a designer vaccine for each subject, it is feasible to sequence virus from that subject to try to get a good match from within a small reference set of vaccine options. The first thing considered was a US-based B clade trial population, focusing on the Gag protein. A Southern African based reference vaccine set, and a global vaccine set were designed, as well as an updated US-based B clade design. p24 is the most highly conserved sub-protein in Gag and can be excised from the larger Gag protein to provide a conserved region of ~230 amino acids in length. A conserved region approach was also considered as an alternative to Gag, perhaps focusing on regions in Gag and Pol, possibly including the conserved stretch of Nef as well as any other proteins of interest.

This is a very different optimization question from trying to design a set that provides optimal population coverage for a prophylactic vaccine. In the prophylactic case, it is not known which viruses might be encountered by the vaccine. In a therapeutic case the infecting virus sequence can be obtained and matched.

Optimization was done considering two things: first, to maximize the matches from a subject's infecting viruses and second, to minimize the mismatches so that the vaccine response is as targeted as possible on the relevant epitopes.

The phylogeny within HIV major clades tends to have little clear structure. Rather it is a "starburst" with very long external branches, and very short poorly defined internal branches near the base. Part of this structure is likely due to intra-subtype recombination. While that is hard to quantify, recombination is certainly occurring relatively frequently, and by analogy with what is seen in terms of inter-subtype recombination, it is likely to be extensive. Given the structure of the tree, simply using clustering on a phylogenic tree to define the reference set of possible vaccines will not be as effective because within-clade associations are of limited meaning from an "epitope perspective". Instead, sequence relationships should be considered by the relevant measure, and the reference set should be selected based on potential epitope similarities between natural strains and putative vaccine designs.

12-mers were optimized considering class II epitopes, but the code can use any length k-mers as a reference point, where k is the putative potential epitope length. 9-mers were also used. In past work with the mosaics, the optimal solution for 9-mers has been very nearly optimal for other nearby lengths (8, 10, 11, 12), and that is expected to carry over with the new algorithms described here. 9-mers have been used for certain Tailored vaccine sets disclosed herein.

Optimality was defined in terms of k-mer coverage. This is defined by replacing each sequence with a "bag of epitopes," i.e., an unordered list of all the k-mers that appear in the sequence. A bag of epitopes can be defined for a set of sequences by making a list of all k-mers that appear in any of the sequences in the set. The coverage of a given sequence S by a set of sequences $Q=\{q_1, q_2, \ldots, q_N\}$ is given by the fraction of epitopes in S's bag that are also in the collective bag of the Q sequences, where Q might be a polyvalent combination in a vaccine cocktail. It is this coverage that was optimized. Another quantity of interest was the fraction of epitopes in the Q-bag that are not in the S-bag. Although it is not (currently) used directly in the optimization, a smaller fraction of these extraneous epitopes is preferred, and these numbers are calculated for comparisons and experimental design.

Six (6) ways of finding "central sequences" were evaluated when performing clustering for a Tailored vaccine incorporated into the Tailored vaccine analyses code (see below). An EpiGraph solution was deemed best, and was used for the final code. Several clustering strategies were also tried.

Here are the strategies tested to define amino acid based central sequences of clusters:

1) Consensus: The consensus was a common standard, obtained by concatenating the most common amino acid in an alignment.

Potential Epitope (k-mer) based:

2) Episensus: This approach solves for a single central sequence within a population or within a cluster. Two algorithms were tested for finding the episensus. The first is the drop-in-place algorithm. This starts with the consensus as a "substrate". Excluding very rare k-mers, (those that are only found 1 time in the population), start with rare low frequency variants and replace the consensus k-mers with the rare variant, then keep replacing with variants, going up through the list of all k-mers based on their frequency, replacing and overwriting with more and more frequent variants until the most frequent variants across k-mers are left "standing"; overlapping k-mers with higher frequency will naturally tend to override peptides that overlap with lower frequencies. The second algorithm is EpiGraph, was described in Example 1. Epigraph sequences are more quickly calculated than GA mosaics, and so were readily incorporated into a clustering algorithm required to design a Tailored vaccine. In an experiment with a set of 690 aligned sequences of 556 amino acids that comprise the Gag protein (SEQ ID NOs: 1-690), the EpiGraph solution was very close to a consensus, and was also very close to the single best mosaic, with only one amino acid difference from the other two centroids.

3) Sequential: This approach solves for a set of N vaccine option sequences. Here, the episensus is first defined for the population, and this is $q_1$. Next, all k-mers that are already covered by $q_1$ are excluded, and the approach solves for the second sequence in the series by the same drop-in-place process, to yield $q_2$. Then all k-mers already covered by $q_1$ and $q_2$ are excluded, and the approach solves for $q_3$ and so on until it has been solved for a set of N sequences, each including ever rarer versions of the potential epitopes.

4) Iterative: This is an iterative version of the sequential algorithm. It also produces a set of N vaccine option sequences, usually with better coverage than the sequential approach, but without the preferential ordering that the sequential algorithm produces. Starting with a sequential solution $q_1, q_2, \ldots, q_N$, all the epitopes that are in the data sequence set are identified, and then the epitopes that are covered by $q_2, \ldots, q_N$ are excluded. By solving for the episensus using the remaining (non-excluded) epitopes, a new value is obtained for $q_1$. The next step does the same thing with $q_2$, excluding epitopes in $q_1, q_3, \ldots, q_N$. And so on for $q_3$ through $q_N$.

5) Mosaic (GA mosaic): defined using the original genetic algorithm (GA). Mosaic refers to the genetic algorithm termed Mosaic and/or antigen sequences produced by the GA. Here, a set of mosaics of size N are solved for all at once, or the best single mosaic can be solved for, fixed, and solved for a complementary set of 5 to make a total of 6 vaccine option sequences. This strategy was employed to enable direct comparisons with clustering strategies described below.

6) Best natural: This approach solves for a set of N vaccine option sequences. The natural strain in a set is identified that is most "epitope centric", i.e. it has the most common k-mers. To find it, for every k-mer in a given natural strain, a frequency can be assigned to that specific form based on its frequency in the population, and then sum the frequencies as a measure of how well the natural strain covers the population. The natural strain with the highest score is the best single strain, Nat.1. Then, the k-mers that are covered by Nat.1 can be eliminated from the scoring scheme, and the best complement to Nat.2 can be picked by finding the best natural strain for epitope coverage excluding those epitopes already covered by Nat.1. This is done iteratively, so k natural strains are picked, where k is the number of vaccine options wanted to be considered, and they are ordered so Nat.1 is the best single strain, Nat.2 the best complement to Nat.1, Nat.3 the best complement to (Nat.1+Nat.2).

Vaccine options have been explored that are designed according to the following general strategies, comparing new ideas to specifically address therapeutic vaccine population sequences that have been designed in the past to optimize for population coverage.

If all subjects were to get the same vaccine (this might work better with conserved regions only), sequencing and tailoring are not done—these are universal designs, not optimized for each individual:

Consensus: Find a single universal sequence that best covers the population.

Candidates for this 1-universal sequence included: a population consensus, the best single GA mosaic, the episensus, and the most "epi-centric" natural strain.

EpiGraph: Find either 2 or 3 population-based sequences and give them to everyone in the population. This population-based strategy was compared using the GA mosaic, the best natural strains, and the sequential and iterative mosaic solution. Since EpiGraphs are now available, and an improvement over Mosaics as we can also exclude rare epitopes, we use them.

In contrast, for a Tailored vaccine, each individual would get only the vaccine sequences that best matched his or her infection: Manufacture, for example, 6 vaccine antigen sequences, and pick the best one, or the best combination of 2 or 3 from among those 6 for delivery to the patient; i.e., choose those that provide the best coverage of a patient's infecting strain, with the fewest mismatched epitopes. Several strategies for this scenario were explored.

a. Cluster sequences with a k-means-like strategy to create 6 clusters, 1500 iterations were done (each of these iterations was a trial split-and-merge step followed by a few regular iterations) for the final sets, defined centroid sequences from these 6 clusters for vaccine sets. The distance between two sequences was defined as one minus the coverage of one sequence's epitopes by the other sequence. Initially, 6 randomly selected natural strains were used to seed the clusters. This gave a very highly related set of 6 centroid sequences. It was determined that if more natural diversity was represented, this would create a better set of reagents to create tailored vaccines. Next, the 6 clusters were seeded with most complementary 6 natural (Nat6) strains as these are very distinctive, and then reassigned the center based on the clusters as the episensus, and iteratively re-clustered, and re-centered. This strategy was compared to starting with the 6 best natural strains and using a consensus as the cluster centroid instead of the episensus, and the episensus gave slightly better coverage. Enforcing a minimum cluster size also gave slightly better coverage (1, 5 and 20 as minimum cluster sizes were tried), so a minimum cluster size was incorporated as a constraint. A minimum size of 20 was better than 1 or 5. To implement a minimum size, if in a given cycle the number of sequences in a cluster size falls below the minimum size, the members of this "too-small cluster" are each reassigned to best centroid from the other five clusters. To make a new cluster to replace the one that was lost, the cluster that has the greatest average distances to its centroid was split by taking two random natural sequences from within the cluster as centroids and reforming two clusters about them, recalculating the centroids, and going on to the next step with these new six clusters. The centroids of these clusters were very close to the center of the tree. It was determined from the sequences that this is due to replication of the consensus repeatedly within the clusters dominating the signal.

b. Episensus+(5 cluster centers). Here, the central sequence was first defined for the whole population using the EpiGraph algorithm (the population episensus), fixed for inclusion as a vaccine reagent. Any epitopes that match the population episensus were excluded from clustering considerations. Sequences are clustered as before, with a minimum size but this time 5 clusters based on all potential epitopes except those found in the episensus, so the clusters complement the population episensus, were targeted. This was determined to be the best solution for Gag. By including the population episensus in each subject's tailored vaccine, even if a given most common k-mer is not evident in their sampled HIV sequences, it might be lurking or a common form for reversion, given HIV's frequent amino acid toggling between common forms. The second complementary sequence from one of the 5 clusters would then add to the variant cross-reactive potential between the vaccine and the infecting strain.

c. Fix the best EpiGraph, add 5 mosaic complements to get a set of six (the 5 added are not ordered), or fix the best natural, add 5 natural in series.

Figure 6:
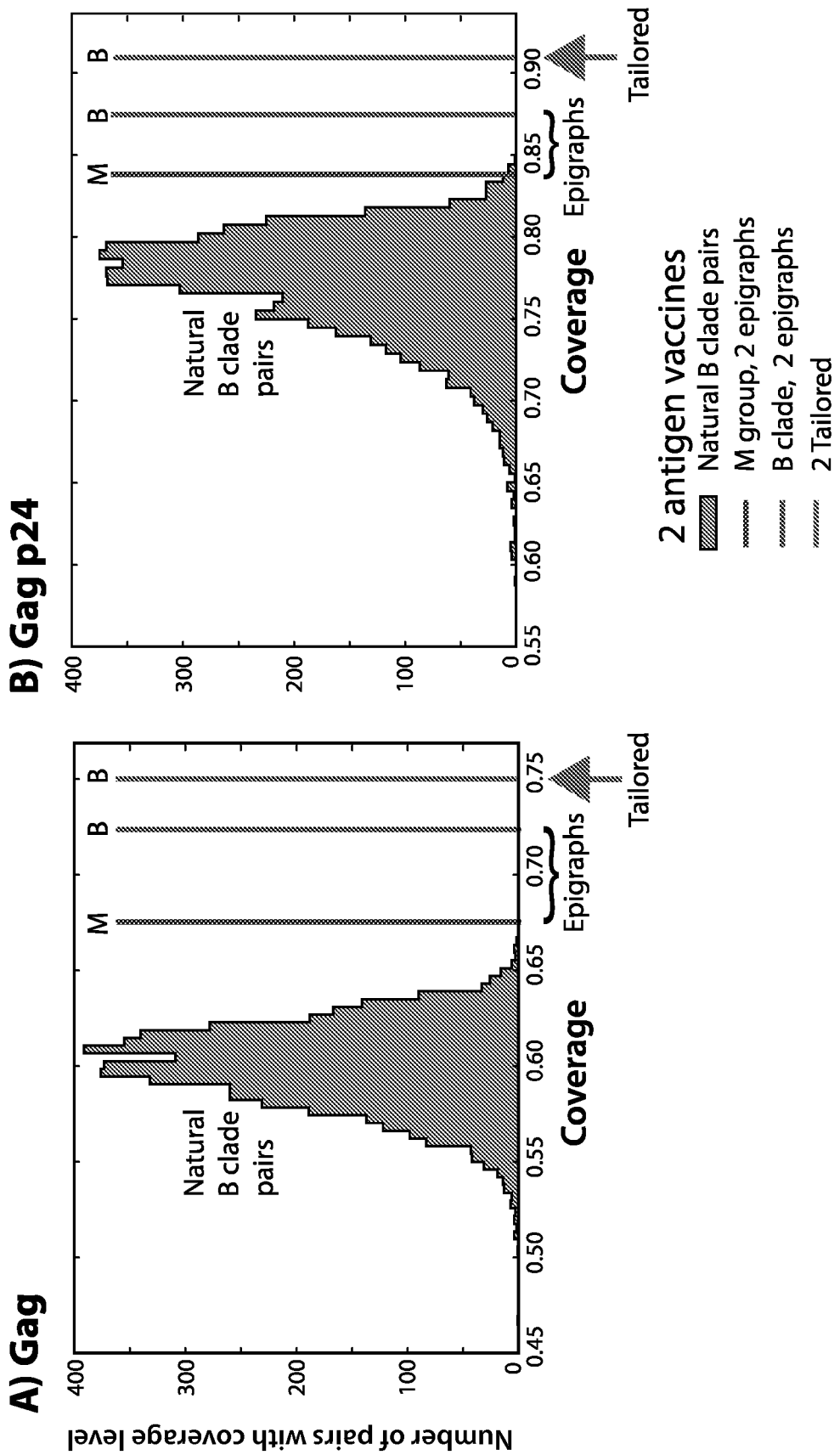
FIGS. 6A-B show two-antigen vaccine coverage. Comparisons illustrating the average epitope coverage per sequence of the contemporary B clade sequences isolated in the United States, which was considered as a hypothetical target population for a therapeutic vaccine. To illustrate potential T-cell epitope (PTE) coverage using a pair of natural within-clade sequences as vaccine antigens, 5000 randomly selected pairs of natural B clade sequences (gray) were evaluated as potential vaccines, and the distribution of average coverage of the 189 contemporary B clade US sequences is shown in the grey histogram. This is compared to the average coverage provided by a 2 antigen set of M group EpiGraphs (M database), a two antigen set of global B clade EpiGraphs (B database), and a US B clade tailored vaccine where the 2 best matches from a set of 6 representative EpiGraphs for manufacture were chosen as a "tailored" match for each of the 189 natural B clade US sequences.

After extensive comparisons and refinements, we favored using the EpiGraph algorithm to define the center of clusters for Tailored vaccines. A set of 6 Gag protein antigens for manufacture in a Tailored design, targeting either a global M group vaccine, a contemporary B clade vaccine, and a contemporary C clade vaccine for Southern Africa are provided. A comparison of coverage of natural contemporary B clade sequences using 2 natural B clade sequences, M group EpiGraphs, B clade EpiGraphs, or B clade tailored is shown in the FIG. 6A-B; B clade Tailored designs provide the best epitope coverage.

The various scenarios can be summarized with a few numbers as seen in Table 3, which are denoted M, C, T, A, and P. These are described below in terms of the number of "pills" (ie, vaccine antigens) for each category:

M=Manufactured, total number of pills created, from which some subset is chosen for each individual. (Typically, we imagine M=6 or fewer.)

C=Common, those pills that everybody gets, possibly in addition to some tailored pills.

T/A=Tailored/Alternatives, T is the number of tailored pills (out of A alternatives) that are given to each individual, possibly in combination with some common pills. P=Per-subject total (T+C), the number of pills given to each individual.

TABLE 3

| Centroid | P | C | T/A | M | COVER >good | EXTRA >bad | DELTA >good |
|---|---|---|---|---|---|---|---|
| Common: everyone gets the same population-based vaccine: | | | | | | | |
| Consensus | 1 | 1 | 0/0 | 1 | 0.5070 | 0.4913 | 0.0157 |
| 1-GA Mosaic | 1 | 1 | 0/0 | 1 | 0.5072 | 0.4911 | 0.0161 |
| Episensus | 1 | 1 | 0/0 | 1 | 0.5065 | 0.4918 | 0.0147 |
| Natural | 1 | 1 | 0/0 | 1 | 0.4793 | 0.5191 | −0.0398 |
| 2-GA Mosaic | 2 | 2 | 0/0 | 2 | 0.5960 | 0.6692 | −0.0732 |
| 2-iterMosaic | 2 | 2 | 0/0 | 2 | 0.5965 | 0.6346 | −0.0381 |
| 2-Natural | 2 | 2 | 0/0 | 2 | 0.5473 | 0.6584 | −0.1110 |
| 3-GA Mosaic | 3 | 3 | 0/0 | 3 | 0.6346 | 0.7424 | −0.1078 |
| 3-iterMosaic | 3 | 3 | 0/0 | 3 | 0.6534 | 0.7190 | −0.0656 |
| 3-seqMosaic | 3 | 3 | 0/0 | 3 | 0.6429 | 0.7119 | −0.0690 |
| 3-Natural | 3 | 3 | 0/0 | 3 | 0.5941 | 0.7308 | −0.1367 |
| 6-interMosaic | 6 | 6 | 0/0 | 6 | 0.7205 | 0.8324 | −0.1119 |
| 1 + 5-GA Mosaic | 6 | 6 | 0/0 | 6 | 0.7048 | 0.8241 | −0.1193 |
| 6-Natural | 6 | 6 | 0/0 | 6 | 0.6628 | 0.8104 | −0.1476 |

In Table 3, the single underlined numbers indicate that on average >60% of the 12-mers in natural sequences are covered by the vaccine (GOOD), while the double underlined numbers indicate that over 70% of the 12-mers on average are not present in the natural stains.

Tailored—Choose the Best 1 of 6 for Each of the 690 Population Sequences:

Not much better (0.54 vs 0.51) than just making one for the whole population, but C6-epi is the best of class if 6 vaccines were going to be made, and give one of the six to a subject based on their sequence.

| C6-epi | 1 | 0 | 1/6 | 6 | 0.5366 | 0.4616 | 0.0750 |
|---|---|---|---|---|---|---|---|
| 1 + 5-Epi-C5 | 1 | 0 | 1/6 | 6 | 0.5079 | 0.4904 | 0.0175 |
| 1 + 5-GA Mosaic | 1 | 0 | 1/6 | 6 | 0.5083 | 0.4900 | 0.0183 |
| 1 + 5-iterMosaic | 1 | 0 | 1/6 | 6 | 0.5074 | 0.4909 | 0.0165 |
| 6-iterMosaic | 1 | 0 | 1/6 | 6 | 0.3979 | 0.6008 | −0.2029 |
| 6-Natural | 1 | 0 | 1/6 | 6 | 0.4863 | 0.5122 | −0.0259 |
| C6-NaturalSeed | 1 | 0 | 1/6 | 6 | 0.5291 | 0.4692 | 0.0599 |

Tailored Best Pair from a Group of Six

| C6-epi | 2 | 0 | 2/6 | 6 | 0.5785 | 0.5313 | 0.0472 |
|---|---|---|---|---|---|---|---|
| 1 + 5-Epi-C5 | 2 | 0 | 2/6 | 6 | 0.6255 | 0.6310 | **−0.0055 \*\*** |
| 6-interMosaic | 2 | 0 | 2/6 | 6 | 0.5552 | 0.6859 | −0.1307 |
| 6-seqMosaic | 2 | 0 | 2/6 | 6 | 0.6075 | 0.6331 | −0.0256 |
| 1 + 5-GA Mosaic | 2 | 0 | 2/6 | 6 | 0.5932 | 0.6401 | −0.0469 |
| 6-Natural | 2 | 0 | 2/6 | 6 | 0.5759 | 0.6431 | −0.0672 |

Hybrid Tailored Pair: Fix the Population Center, Add 1 of 5 Centroids to Best Complement a Fixed Sequence to Cover Each of the Test Sequences—

| 1 + 5-Epi-C5 | 2 | 1 | 1/5 | 6 | 0.6255 | 0.6310 | −0.0055 ** |
|---|---|---|---|---|---|---|---|
| 1 + 5-GA Mosaic | 2 | 1 | 1/5 | 6 | 0.5922 | 0.6394 | −0.0472 |
| 1 + 5-Natural | 2 | 1 | 1/5 | 6 | 0.5724 | 0.6395 | −0.0671 |
| 6-seqMosaic | 2 | 1 | 1/5 | 6 | 0.6071 | 0.6330 | −0.0259 |
| 6-iterMosaic | 2 | 1 | 1/5 | 6 | 0.5280 | 0.7039 | −0.1759 |

Hybrid Best Three— fix the population center, and 2 of 5 centroids to best complement a fixed sequence so cover the test sequence.

| 1 + 5-Epi-C5 | 3 | 1 | 2/5 | 6 | 0.6590 | 0.6868 | −0.0278 |
|---|---|---|---|---|---|---|---|
| HBP-6-iterMosaic | 3 | 1 | 2/5 | 6 | 0.6586 | 0.7079 | −0.0493 |
| HBP-1 + 5-GA Mosaic | 3 | 1 | 2/5 | 6 | 0.6447 | 0.7155 | −0.0708 |

Common: Everyone gets the same population-based vaccine, either 1 or 2 vaccine antigens are delivered:

| Common | Natural | 1 | 1 | 0.4793 | 0.5191 |
|---|---|---|---|---|---|
| Common | Mosaic | 1 | 1 | 0.5072 | 0.4911 |
| Common | 2-Natural | 2 | 2 | 0.5473 | 0.6584 |
| Common | 2-GA Mosaic | 2 | 2 | 0.5960 | 0.6692 |
| Common | 2-iterMosaic | 2 | 2 | 0.5965 | 0.6346 |
| Tailored | C6-epi | 2 | 6 | 0.5785 | 0.5313 |
| Tailored | 1 + 5EpiC | 2 | 6 | 0.6341 | 0.6361 |
| Tailored | 1 + 5EpiC5 | 3 | 6 | 0.6590 | 0.6868 |
| Common | 3-GA Mosaic | 3 | 3 | 0.6346 | 0.7424 |

Exact match 1+5-Epi-05:

| | Optimized for 9 | | Optimized for 12 | |
|---|---|---|---|---|
| | COVER | EXTRA | COVER | EXTRA |
| Evaluated for 9 | 0.7098 | 0.5744 | 0.7066 | 0.5535 |
| Evaluated for 12 | 0.6301 | 0.6525 | 0.6341 | 0.6361 |

And off-by-one considered a match 1+5-Epi-05:

| | Optimized for 9 | | Optimized for 12 | |
|---|---|---|---|---|
| | COVER | EXTRA | COVER | EXTRA |
| Evaluated for 9 | 0.9207 | 0.1783 | 0.9183 | 0.1723 |
| Evaluated for 12 | 0.8722 | 0.2590 | 0.8708 | 0.2474 |

** these are likely the best solution. A population episensus was made, the 12-mers found in the episensus for clustering were excluded. When the population episensus is fixed and the best episensus of the other 5 complementary clusters is picked to pair with it, the exact same answer is obtained as when the best pair among those 6 variants was picked. This means the population episensus was always one of the best pair.

Off by One:

For the estimates above, only perfect matches were considered, for an epitope to match between a vaccine cocktail and a natural strain, a perfect 12/12 match was required. Mismatches are often well tolerated, particularly for class II epitopes, if a match requires 11/12 agreement, a mismatch is 10/12 or less, things look more optimistic. The truth is probably somewhere in between, and 10/12 may be acceptable is some cases as well. Here the likely best option is compared to a comparable best natural strain option, with perfect matches:

Perfect match (extracted from the table above):

| | | | | | | | |
|---|---|---|---|---|---|---|---|
| 1 + 5-Epi-C5 | 2 | 1 | 1/5 | 6 | 0.6255 | 0.6310 | −0.0055 ** |
| 1 + 5-Natural | 2 | 1 | 1/5 | 6 | 0.5724 | 0.6395 | −0.0671 |

And off-by-one considered a match:

| | | | | | | | |
|---|---|---|---|---|---|---|---|
| 1 + 5-Epi-C5 | 2 | 1 | 1/5 | 6 | 0.8700 | 0.2524 | 0.6176 |
| 1 + 5-Natural | 2 | 1 | 1/5 | 6 | 0.8412 | 0.3112 | 0.5300 |

Three pills, one general (same for everybody). And two tailored pills, the best pair of the remaining five.

Figure 7:
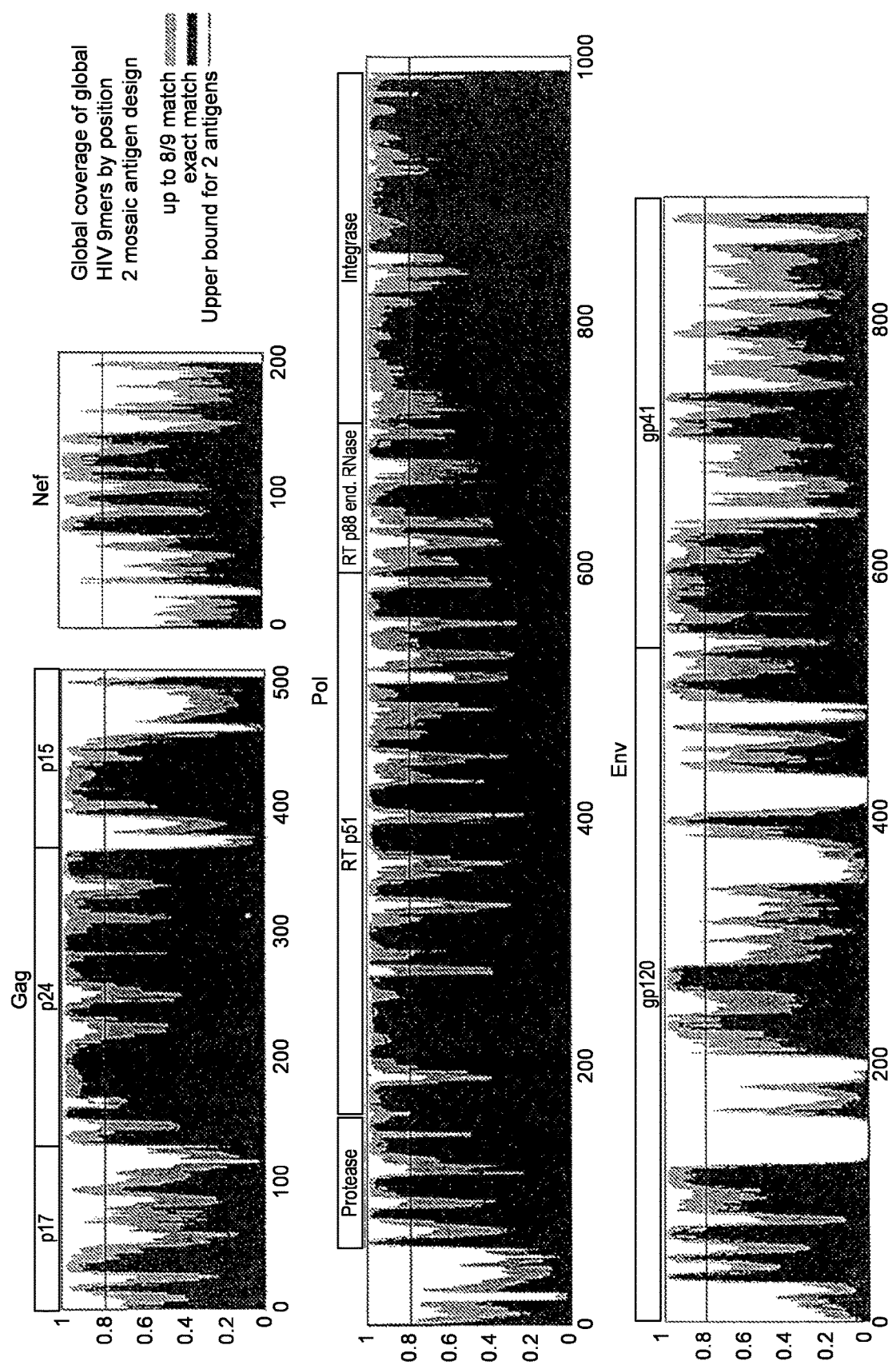
FIG. 7 shows mapping potential epitope coverage spanning the HIV proteome.
Figure 11:
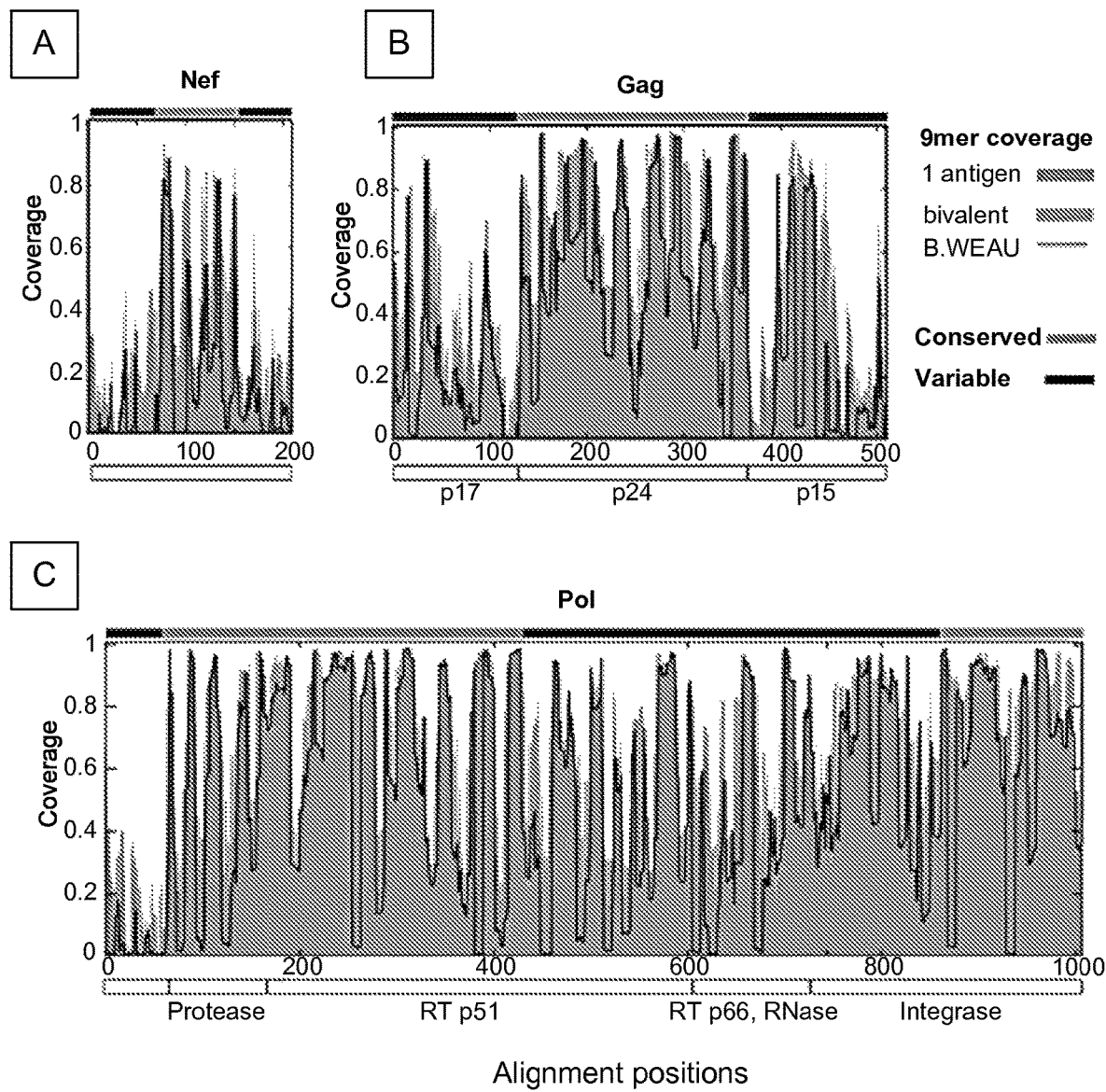
FIGS. 11A-C shows conserved regions within: Nef (FIG. 11A), Gag (FIG. 11B), and Pol (FIG. 11C) defined based on the potential for potential T-cell epitope (PTE) coverage by a bivalent (i.e., 2 antigen) vaccine.
Figure 12:
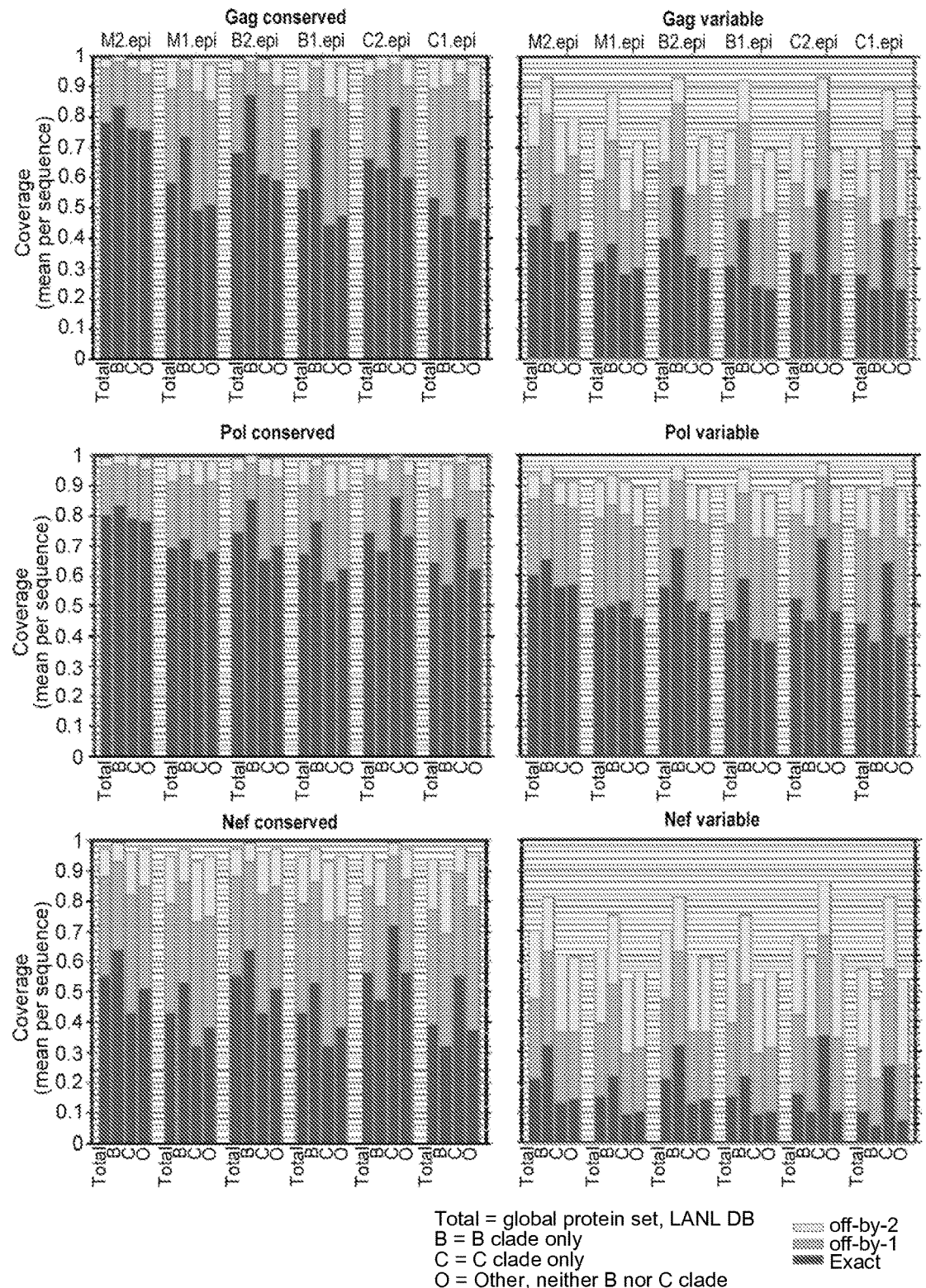
FIG. 12 illustrates the average Epigraph coverage of each of the conserved regions by different vaccine antigens, compared to the more variable sections of the proteins.

Example 4: Design and Optimization of a Clade B HIV-1 "Tailored" Antigen Cocktail HIV diversity at the population level begins with rapid evolution within each infected host. Much of the within host diversity is a direct consequence of immune escape (Bar, K. J. 2012. *PLoS Pathog* 8:e1002721, Liu, M. K. 2013. *J. Clin. Invest.* 123:380-93—and escape variants arise soon after infection (Fischer, W. 2010. *PLoS One* 5:e12303). The goal of prophylactic vaccines is to rapidly eliminate the infecting strain or prevent it from infecting in the first place. Since it is not known which strain will be transmitted, prophylactic vaccines have to elicit immune responses that would be active against any variant that might be encountered. In contrast, an immunotherapy can be directed against a known viral population present within a given host. Prophylactic and therapeutic HIV vaccines thus have to be designed with these distinct requirements in mind. As shown in FIG. 7, mosaic solutions approach the maximum possible epitope coverage for a given HIV population. The figure also reveals differences in the conservation of HIV proteins, with large segments of Gag, Nef and Pol being highly conserved whereas most of Env as well as most small, auxiliary proteins (data not shown) are highly variable. While mosaics offer a near optimal solution for epitope coverage in a population for a prophylactic vaccine, they do not exploit the added information of knowing the sequence of the infecting strain targeted in a therapeutic setting.

The implementation of a tailored vaccine design strategy requires manufacturing a manageable number of vaccine reagents that maximally capture the epitope diversity of the target population, sequencing HIV from the infected vaccine recipient, and then selecting from among the vaccine reagent pool the subset of antigen inserts that best matches the subject. The tailored vaccine strategy is thus conceptually distinct from mosaic vaccine design.

98% of approximately 150,000 HIV sequences that have been sampled in the U.S. are clade B. The US-sampled B-clade Gag sequences currently available from the Los Alamos HIV database were used. There were 690 intact Gag sequences in this set (SEQ ID NOs. 1-690), each derived from a different infected subject, representing a cross-section of the diversity in US HIV strains. To maximize T cell epitope coverage in a hypothetical vaccine while fixing the number of different Gag sequences that need to be contained in a vaccine cocktail, a novel computational strategy was devised that couples the use of an epitope-based consensus (or "episensus") sequence algorithm with k-means-like clustering. Unlike a simple consensus sequence, which takes the most common amino acid in each position of the alignment, the episensus seeks the most common epitope (e.g., 12-mer) starting in each position of the alignment. However, one cannot simply take the most common epitope at each position, because the epitopes overlap, and that can lead to conflicts in nearby amino acids. The goal is to deal with those conflicts in a way that leads to maximal epitope coverage of a population by a vaccine.

To define a small set of antigens for manufacture that represent the population epitope diversity, a k-means like approach was used to partition the 690 Gag sequences into distinct clusters based on epitope similarity, and separate episensus sequences were generated for each cluster to serve as the central sequence of the cluster. Coverage of individual variants levels off after 5-6 clusters, and 6 vaccine vectors with 6 HIV antigen variants is feasible to manufacture, so a set of 6 antigens was initially targeted. The algorithm starts with 6 randomly selected natural strains as initial centroid sequences, and assigns each of the remaining sequences to whichever of the 6 is closest. Within each of the 6 clusters, a new centroid sequence is computed, based on the episensus of the sequences in that cluster. All of the sequences are then re-assigned according to which of the new centroids is closest. This process converges to a k-means-like optimization for the design of the 6 vaccine antigens, which are taken to be the episensus centroids of the individual clusters, and these antigens could be used as a manufactured set, from which to select those that provide the best-match for a given vaccine.

A hybrid approach was found to substantially improve epitope coverage, while minimizing increases in potential vaccine-specific responses. In the hybrid strategy, the central sequence was computed for the whole population (the population episensus), and subsequent clustering was based exclusively on epitopes that were not found in the central sequence. In this way, the cluster episensus sequences complement the population episensus. Thus, the 6-sequence reagent pool consists of the one population episensus and five complementary-cluster centroid sequences, and subjects would be given a two-antigen tailored vaccine, the population episensus paired with the best complementary sequence. This strategy yielded more diverse sequences in the reference set, and improved potential coverage of natural Gag sequences in the test population as seen in Table 4.

TABLE 4

Average per-strain coverage of potential epitopes in US clade B Gag by different vaccines.

| Vaccine | Delivered | Manufactured | % matched to natural Gag | % non-matched to natural Gag | Improvement factor |
|---|---|---|---|---|---|
| 1 Natural | 1 | 1 | 47.9 | 51.9 | |
| 1 Mosaic | 1 | 1 | 50.7 | 49.1 | 1.06 |
| 1 Episensus | 1 | 1 | 50.7 | 49.1 | 1.06 |
| 2 Natural | 2 | 2 | 54.7 | 65.8 | 1.14 |
| 2 Mosaic | 2 | 2 | 59.6 | 66.9 | 1.24 |

TABLE 4-continued

Average per-strain coverage of potential epitopes in US clade B Gag by different vaccines.

| Vaccine | Delivered | Manufactured | % matched to natural Gag | % non-matched to natural Gag | Improvement factor |
|---|---|---|---|---|---|
| 2 Tailored | 2 | 6 | 63.4 | 63.1 | 1.32 |
| 3 Natural | 3 | 3 | 59.7 | 73.1 | 1.35 |
| 3 Mosaic | 3 | 3 | 63.4 | 74.3 | 1.32 |
| 3 Tailored | 3 | 6 | 65.9 | 68.7 | 1.37 |
| 6 Natural | 6 | 6 | 66.3 | 81.0 | 1.38 |
| 6 Mosaic | 6 | 6 | 72.1 | 83.2 | 1.51 |

A tailored vaccine, 2- or 3-antigen design, was made for each of the 690 variants, selected from the population episensus and the 5 cluster derived complementary sequences. This was compared to the potential epitope coverage of population-based vaccine strategies where every vaccine would be given the same vaccine, either mosaic or best-natural combinations. "Delivered" indicates the number of antigens that would be included in a vaccine cocktail. "Manufactured" indicates the size of the reference pool of vaccine antigens that would need to be synthesized to choose among for the tailored approach to be used. The "% matched" indicates the average number of potential epitopes perfectly matched between each of the natural Gag variants and the vaccine; the higher this value, the more likely vaccine responses will be cross-reactive with natural variants. The "% non-matched" represents the fraction of potential epitopes in the vaccine that are not found in a given natural Gag sequence, calculated for each of the 690 sequences separately then averaged. The higher this value, the greater the potential the vaccine to elicit vaccine-specific responses that may detract from cross-reactive responses. The improvement factor indicates the increase in coverage using the proposed new vaccine design options, over using a single best natural strain.

The tailored vaccine solutions optimized on 12-mers are nearly optimal for 9-mers, and vice-versa, so clusters based on 12-mers should work well for both class I and class II epitope presentation as seen in Table 5.

TABLE 5

Allowing a single amino acid mismatch in the 9mer or 12mer evaluation to be considered as a positive match when calculating the average coverage of a 2-protein tailored design.

| | Optimized for 9mer | | Optimized for 12-mer | |
|---|---|---|---|---|
| | % Matched | % Non-matched | % Matched | % Non-matched |
| Evaluated for 9-mer | 92.07 | 17.83 | 91.83 | 17.23 |
| Evaluated for 12-mer | 87.22 | 25.90 | 87.08 | 24.74 |

Finally, the tailored vaccine approach theoretically does very well if 1 out of 12 mis-matches are tolerated in potential epitopes, rather than requiring identity (Table 5); given this more lenient, and perhaps biologically more realistic, measure, approximately 90% of vaccine responses to tailored vaccines may be cross-reactive with epitopes in matched natural Gags. The tailored vaccine approach was superior to population mosaics, consensus sequences, and the best natural strains in terms of both maximizing epitope coverage of Gag sequences, and minimizing potentially deleterious vaccine-specific epitopes (FIG. 8). The code can also be applied to tailoring vaccines using multiple sequences rather than use one representative each from infected individuals, and applying the tailored vaccine design strategy to different populations (the C clade epidemic in Southern Africa, the 2-clade regional epidemic in Thailand, and global M group set) are explored.

Tailored vaccine antigens can provide better coverage (compared to population-based antigens) of natural sequences when the infecting strain is known.

Example 5: Dual Expression Vectors

Using the population episensus antigens and/or the tailored antigens described herein, dual expression vectors are generated, with each expressing a complete Gag antigen and a second HIV antigen. The second HIV antigen can be, for example, a fusion protein of reverse transcriptase (RT) and the central part of Nef. Integrase is not included, as it is a rather poor stimulator of T cell responses. Using CMV vectors (e.g., RhCMV or HCMV vectors) as dual expression vectors, it is possible to simultaneously induce T cells to two different SIV or HIV antigens.

For example, panels of up to six HCMV vectors containing tailored Gag sequences based on the EpiGraph algorithm developed are generated (one vector expressing a Gag population episensus antigen and five vectors that each express a complementary cluster-based Gag antigen), and panels of antigens covering RT and the central region of Nef are also designed. One vector expressing a Gag population episensus antigen plus two vectors each expressing a different Gag antigen can be selected from among the five complementary cluster-based antigens are provided. These vectors can also contain one of two complementary HIV-1 EpiGraph RT/nef sequences. When tailoring is not predicted to improve coverage due to the high conservation of these sequences, the 2-mosaic solution are retained and used for the vector. For example, one RT/nef mosaic is included in the population episensus vector and the other is used in the tailored vectors. A panel of HCMV-based vaccine vectors that can enter vaccine production is generated by sequencing the resulting vectors and characterizing them for antigen expression and growth in vitro.

Synthetic codon-optimized DNA inserts are generated corresponding to Gag, RT and Nef mosaic and the tailored antigens designed in Example 3.

Example 6: Transient Expression of Viral Antigens Developed Using the EpiGraph Approach Antigens designed to maximize the epitope frequency using the EpiGraph algorithm resemble natural sequences but no longer code for native proteins. While the theoretical guidelines for expression of these artificial sequences are adhered to in the construction of these sequences, proteins encoded by them may exhibit unanticipated expression profiles or fail to express a stable full length protein.

To evaluate the expression profile of these sequences in the context of mammalian cells EpiGraph sequences were synthesized and cloned for transient transfection. DNA encoding these constructs was synthesized (Genscript, Piscataway, N.J.) to contain compatible cloning sites for plasmid vectors (pcDNA3.1 and pOri). All inserts were codon optimized for the respective host (rhesus, SIV or human, HIV). Each construct was also modified to eliminate residual enzyme activity of the native sequence as described in Kulkarni et al. Vaccine (2011). Positions deleted were based on the amino acid sequence relative to Clade B EpiGraph-1. Amino acids deleted include; "DTG" associated with protease activity (positions 81-83), "YMDD" associated with reverse transcriptase activity (positions 338-341), "E" associated with RNaseH activity (position 633), "D" associated with Integrase activity (position 779), "D" associated with Integrase activity (position 831), and "E" associated with Integrase activity (position 867). Synthetic DNA was rehydrated in water and digested with restriction endonucleases (5' NheI, 3' BamHI) followed by heat inactivation. The plasmid vector was linearized with compatible endonucleases and treated with calf intestinal phosphatase to prevent recircularization of empty vector. Vector and insert fragments were resolved by agarose gel electrophoresis to confirm digest fragment sizes and cleaned for ligation by PCR purification kit (Thermo Scientific). Inserts were ligated to linearized vector at approximately 3:1 insert to vector ratio for 15 minutes at room temperature using a rapid ligation kit (Roche, Indianapolis, Ind.), transformed into chemically competent *E. coli* (DH5-alpha), and plated on antibiotic selection plates. DNA from resulting colonies was screened by restriction digestion for inserts.

Clones containing each of the correct inserts in the appropriate orientation relative to vector promoter and poly (A) sequences were grown in liquid culture for plasmid DNA purification. Actively growing sub-confluent Hela cells in 12 well tissue culture plates received 500 ul of fresh media (DMEM 10% FBS) while liposomes were prepared. To generate liposomes containing plasmid DNA, 250 ul of serum free media was mixed with 500 ng of plasmid DNA, and 250 ul of serum free media was mixed with 2 ul of lipid (Lipofectamine 2000, Invitrogen). After 5 minutes incubation at room temperature these solutions were combined, mixed, and incubated for 20 minutes. The DNA containing liposomes (500 ul) formed during this process were added dropwise to the culture and allowed to incubate 12-16 hours after which time the transfection mixture was replaced with fresh media. After an additional day of incubation cultures were harvested by scraping and centrifugation. Supernatants were removed by aspiration and cell pellets lysed by resuspension in 100 ul gel loading dye containing 5% SDS and 10% 2-mercaptoethanol and centrifugation through QiaShred column (Qiagen, Valencia, Calif.).

Expression of EpiGraph proteins was demonstrated by SDS poly-acrylamide gel electrophoresis (SDS-page) and western blotting developed with antibodies to the V5 or hemagglutinin epitope tag engineered into each construct. Briefly, 10% polyacrylamide gels were prepared and loaded with 10 ul (10% of each sample) and electrophoresed at 110-120 volts for 90 minutes. The resolved proteins were transferred to PVDF membranes by semi-dry blotting at 20 volts for 45-50 minutes. Non-specific binding was blocked with a solution of 10% nonfat dry milk in phosphate buffered saline with 0.1% tween-20 (PBS-T) for 60 minutes. HA (Sigma) or V5 (Santa Cruz) antibodies were diluted in 5% milk solution and incubated with membranes for 1 hour followed by 3 washes with PBS-T prior to addition of 1:2000 dilution of horseradish peroxidase conjugated goat anti-mouse (Santa Cruz) secondary antibody for 1 hour. Subsequently blots are washed three times in PBS-T and developed with enzyme linked chemi-luminescence (ECL kit (Thermo-Pierce) and visualized with X-ray film.

All the tested constructs demonstrated robust transient expression for proteins of the predicted molecular weight and confirmed their utility for testing in the CMV vector backbone. (for example, see FIGS. 9A-C).

Example 7: Engineering of EpiGraph Designed Antigens into CMV Vector BAC Constructs and Expression from Reconstituted Virus EpiGraph antigens were designed to maximize the coverage of T-cell epitopes representative of the spectrum of viral sequences and clades of HIV from which they were generated. To utilize these antigens most effectively they have been engineered into CMV vectors which have demonstrated three times the $CD8^+$ T cell spectrum of competing platforms. Broad antigen presentation and lifelong expression profiles of CMV vectors have demonstrated the capacity to protect and cure rhesus monkeys infected with SIV. The EpiGraph antigen design algorithm in combination with CMV vectors may provide even greater coverage of HIV within and across clades when applied to broadly prophylactic vaccines or tailored focused vaccines.

EpiGraph sequences which were demonstrated expression in transient transfection systems were sub-cloned into the recombination plasmid (pOri) and transferred to CMV backbones using BAC recombineering. (Messerle et al. Proc Natl Acad Sci USA. 1997 Dec. 23; 94(26):14759-63; and Borst et al. J Virol. 1999 October; 73(10):8320-9).

BAC recombineering facilitates the manipulation of large DNA sequences utilizing temperature and metabolite regulated recombination enzymes in the context of *E. coli* strain EL250 containing a parental BAC. Recombination is a sequential two-step process consisting of insertion of the antigen sequence with an antibiotic resistance gene (kanamycin) into the target region followed by removal of the kanamycin cassette. The insertion fragments are amplified by PCR from template DNA containing the antigen of interest plus kanamycin using primers with long (50+bp) homology arms.

To prepare the bacterial cells for the insertion step, five ml cultures were grown overnight at 30° C. in Luria Broth (LB) with chloramphenicol, and diluted up to 50 ml the following morning. Bacteria were grown for approximately 3-4 additional hours at 30° C. (to an OD=0.6), and then heat shocked by shaking at 42° C. for 15 minutes to induce the recombination enzymes. Following this induction, bacteria were pelleted (3000 rpm, 10 minutes, 4° C.) and then washed three times in ice-cold water. The *E. coli* cells were rendered electro-competent to receive the PCR product and recombination competent for insertion of the sequence into the target region of the BAC. Purified insert (500 ng) was combined with 100 ul competent *E. coli* on ice, moved to a 0.2 cm cuvette (Fisher), and electroporated using the Bio-rad MicroPulser apparatus. Following electroporation, the bacteria were diluted by addition of 900 ul LB culture media and allowed to recover at 30° C. for 2 hours prior to plating on chloramphenicol/kanamycin plates. Plates were incubated at 30° C. for two days and colonies were screened by restriction digest and PCR for recombination events.

BAC constructs positive for recombination proceeded to the second step where the kanamycin cassette was excised by arabinose induction of the Flip recombinase mediated by flanking FRT sites. Five ml cultures were grown overnight in LB+chloramphenicol and diluted 1:10 the following morning. After three hours of growth the bacteria were treated with L-arabinose (Arcos, 0.1% final concentration) and induced for 1.5 hours at 30° C. Following induction the bacteria were streaked on chloramphenicol plates and incubated for two days at 30° C. Colonies were then replica plated on chloramphenicol/kanamycin and chloramphenicol plates to screen for clones that had lost kanamycin resistance. These clones were further screened by restriction digest and PCR to confirm the construct.

Viral Reconstitution:

To regenerate virus, the BAC DNA was transferred into mammalian host cells permissive for viral growth. BAC DNA purified from 10 ml of an overnight culture was electroporated into approximately 1/5 of a confluent flask of telomerized fibroblasts (~200,000 cells). In brief, cells were pelleted (1,500 rpm, 5 minutes) and resuspended in 700 ul Opti-Mem. This cell mixture was then added to 50 ul of BAC DNA and mixed gently before transfer to a 4 mm cuvette. Electroporation was done using the Bio-rad GenePulser II at 0.25 kV and 0.95 uF. Following electroporation, cells were plated into 100 mm dishes containing DMEM+10% FBS and media was changed the next day to remove cell debris. Cells were observed daily for the formation of plaques and harvested at full CPE. The remaining attached cells were harvested by cell scraper and pelleted by centrifugation (1,500 rpm, 5 minutes), and the supernatant containing reconstituted virus vector was retained for passage of the recombinant virus. Cell pellets were lysed by resuspension in 100 ul gel loading dye containing 5% SDS and 10% 2-mercaptoethanol and centrifugation through QiaShred column (Qiagen, Valencia, Calif.).

Viral EpiGraph Expression:

Expression of EpiGraph proteins were tested by SDS poly-acrylamide gel electrophoresis (SDS-page) and western blotting developed with antibodies to the V5 or hemagglutinin epitope tag engineered into each construct. Briefly, 10% polyacrylamide gels were prepared and loaded with 10 ul (10% of each sample) and electrophoresed at 110-120 volts for 90 minutes. The resolved proteins were transferred to PVDF membranes by semi-dry blotting at 20 volts for 45-50 minutes. Non-specific binding was blocked with a solution of 10% nonfat dry milk in phosphate buffered saline with 0.1% tween-20 (PBS-T) for 60 minutes. HA (Sigma) or V5 (Santa Cruz) antibodies were diluted in 5% milk solution and incubated with membranes for 1 hour followed by 3 washes with PBS-T prior to addition of 1:2000 dilution of horseradish peroxidase conjugated goat anti-mouse (Santa Cruz) secondary antibody for 1 hour. Subsequently blots were washed three times in PBS-T and developed with enzyme linked chemi-luminescence (ECL kit (Thermo-Pierce) and visualized with X-ray film.

All the tested constructs demonstrated robust stable expression for proteins of the predicted molecular weight, thus confirming their utility for immunogenicity testing in the rhesus CMV vaccine model (for example, see FIG. 10A-B).

Example 8 Population Epigraph Vaccines

The Epigraph algorithm were used to create a set of vaccine antigens using CMV vectors initially, however, other vaccine delivery systems can be utilized.

M group (global) was considered, as well as B and C clade (geographically limited use to regions where these particular clades are endemic). Gag, Pol and Nef Epigraph vaccine antigens were generated. B and M group are expressed.

Basic Epigraph Design Attributes:

Epigraphs use a graph theory/dynamical programming approach to design antigens that maximize potential T-cell epitope (PTE) coverage. Under certain conditions they are mathematically optimal, and they are very computationally efficient. Epigraphs have an additional tangible benefit relative to Mosaic antigens, in that the benefit of excluding ever-more rare epitopes in the constructs can be balanced by tolerating minimal PTE coverage costs. These Epigraphs were designed with that in mind, allowing a slight coverage cost (0.005) to ensure that even the rarest epitopes represented in the Epigraph antigens were observed in many of the population sequences (the precise number depends on the input data set).

The input data sets for these Epigraphs were obtained from the HIV database sequence alignment set for each of the proteins, Gag, Pol and Nef, including one sequence per person, circa September 2014. Incomplete sequences were excluded. This left the following numbers of sequences for each protein set, Nseqs is the number of sequences in the input alignment:

| Nseqs | Clade | Protein |
|---|---|---|
| 1729 | B | Gag |
| 1780 | B | Nef |
| 1072 | B | Pol |
| 940 | C | Gag |
| 749 | C | Nef |
| 414 | C | Pol |
| 4596 | M | Gag |
| 4040 | M | Nef |
| 2780 | M | Pol |

Paired Epigraph antigen sets for a bivalent vaccine were sequentially solved using the Epigraph algorithm for unaligned sequences. The sequential solution was used, which allows the use of first Epigraph as a monovalent vaccine in isolation. This means that they are designed so that the best single Epigraph antigen, an "episensus", is solved first to provide the optimal PTE coverage of a population, and then it is fixed for inclusion in the bivalent design. The complement is then solved to give best population PTE coverage by a bivalent pair of antigens that contain the first Epigraph, the episensus. The coverage costs were minimal relative to a simultaneous antigen solution.

An analysis was then performed to determine the coverage cost of excluding rare variants. The data is summarized in the following table. $f_o$ is rare epitope threshold. Sequences are produced after discarding all PTEs that appear in $f_o$ or fewer sequences. Put another way, every PTE that is in the vaccine has appeared in more than $f_o$ sequences. These values of $f_o$ were made as large as possible while achieving a coverage that was within 0.005 of the maximum coverage achieved when $f_o=0$. Nseqs is the number of sequences in the input alignment.

| Protein | Clade | Nseq | $f_o$ |
|---|---|---|---|
| Gag | B | 1729 | 41 |
| Gag | C | 940 | 21 |
| Gag | M | 4596 | 146 |
| Nef | B | 1780 | 50 |

-continued

| Protein | Clade | Nseq | $f_o$ |
|---|---|---|---|
| Nef | C | 749 | 14 |
| Nef | M | 4040 | 100 |
| Pol | B | 1072 | 34 |
| Pol | C | 414 | 11 |
| Pol | M | 2780 | 67 |

The basic Epigraph antigens were designed as full proteins, and these —were —expressed in CMV vectors and tested as either Gag/Nef fusion proteins, or Pol with deletions made for safety, or as the most conserved regions of Gag and Nef fused, or the most conserved regions of Pol fused. Lists of each of the full protein form for expression in the CMV vector are included below with examples for the M group and the B clade.

Conserved regions for vaccine antigens are excised from the full length Epigraph proteins.

The conserved regions within Gag, Pol and Nef were defined based on the potential for PTE coverage by a bivalent (i.e., 2 antigen) vaccine. That is, they were based on the potential for two optimized antigens to provide PTE coverage of the B clade. Sequences for the conserved regions are shown in the listing below. Boundaries were selected to capture the most conserved half of each the three proteins (Gag, Pol and Nef), in the longest contiguous fragment possible, so the conserved regions are interspersed with more variable sections. In Gag, the boundaries simply reflect the boundaries of the p24 Capsid protein.

Example 9: Tailored Therapeutic Antigens

For Tailored antigens, either Gag or the most conserved part of Gag, p24 were used. For one design, the full M group 2015 alignments of 4596 sequences were used, to provide a global solution. An alignment of 189 contemporary B clade sequences were isolated in the US, or an alignment of 199 contemporary C clade sequences from Southern Africa. "Contemporary" refers to viruses that were isolated after 2004; all sequences sampled in the past decade were used to get a reasonable sampling of sequences from each region. Sequences that were not fully resolved or were incomplete were excluded. Regional subtype-specific contemporary viruses were selected because they represent good matches for populations that would be likely for initial proof of concept studies for evaluating for Tailored vaccines; by using single subtype regional sets we could limit the population diversity to enhance the potential for success of an HIV therapeutic vaccine.

These therapeutic vaccine antigens are designed for used in treatment scenarios where they could be matched, or "tailored", to the sequenced infecting virus of the person who would receive the vaccine. 6 vaccine antigens would be manufactured, the best matched 2 or 3 from that set to the individuals infecting virus would be given to an individual to maximize matches between the vaccine and their infecting strain.

Thus full Gag for every epigraph is provided below, for manufacture of the 6 Tailored antigen solution, with p24 as bold face. Either Gag or the more conserved p24 could be used in a tailored vaccine.

Matched PTE scores and mismatched scores (number of extras), for delivery of the n best matched antigens out of a pool of m, for Gag proteins or the interior p24 region, where the n are selected to best cover each individual sequence in the target population. The target populations are the contemporary C clade infected population sampled in Southern Africa, or the contemporary B clade population sampled in the USA. The best solutions use a pool of m=6 antigens, and are bolded; these are the based on the six sequences shown above.

Epitope Coverage of Southern African C Clade Gag

| n m | Coverage | Extras | Vaccine evaluated against data set |
|---|---|---|---|
| 1 1 | 0.39886 | 318.437 | M Epigraph |
| 2 2 | 0.57907 | 681.980 | M Epigraph |
| 1 1 | 0.59591 | 200.809 | C Epigraph |
| 2 2 | 0.70758 | 550.618 | C Epigraph |
| 2 3 | 0.71875 | 559.206 | C Tailored |
| 3 3 | 0.73852 | 778.603 | C Tailored |
| 2 4 | 0.72609 | 550.397 | C Tailored |
| 3 4 | 0.75294 | 805.658 | C Tailored |
| 2 5 | 0.73124 | 549.452 | C Tailored |
| 3 5 | 0.75975 | 800.337 | C Tailored |
| 2 6 | 0.73440 | 527.623 | C Tailored |
| 3 6 | 0.76513 | 767.759 | C Tailored |

Epitope Coverage of Southern African C Clade p24

| n m | Coverage | Extras | Vaccine evaluated against data set |
|---|---|---|---|
| 1 1 | 0.48548 | 114.739 | M Epigraph |
| 2 2 | 0.76864 | 230.593 | M Epigraph |
| 1 1 | 0.73525 | 59.040 | C Epigraph |
| 2 2 | 0.84494 | 204.578 | C Epigraph |
| 2 2 | 0.84494 | 204.578 | C Tailored |
| 2 3 | 0.86153 | 205.387 | C Tailored |
| 3 3 | 0.88154 | 338.417 | C Tailored |
| 2 4 | 0.87000 | 188.307 | C Tailored |
| 3 4 | 0.89175 | 290.854 | C Tailored |
| 2 5 | 0.87699 | 187.849 | C Tailored |
| 3 5 | 0.89945 | 295.930 | C Tailored |
| 2 6 | 0.87996 | 191.538 | C Tailored |
| 3 6 | 0.90373 | 290.985 | C Tailored |

Epitope Coverage of USA B Clade Gag

| n m | Coverage | Extras | Vaccine evaluated against data set |
|---|---|---|---|
| 1 1 | 0.55488 | 237.815 | M Epigraph |
| 2 2 | 0.67323 | 629.333 | M Epigraph |
| 1 1 | 0.61174 | 195.720 | B Epigraph |
| 2 2 | 0.72471 | 553.899 | B Epigraph |
| 2 3 | 0.73615 | 557.254 | B Tailored |
| 3 3 | 0.75734 | 786.772 | B Tailored |
| 2 4 | 0.74354 | 547.725 | B Tailored |
| 3 4 | 0.76973 | 762.524 | B Tailored |
| 2 5 | 0.74786 | 546.111 | B Tailored |
| 3 5 | 0.77777 | 779.487 | B Tailored |
| 2 6 | 0.75226 | 536.619 | B Tailored |
| 3 6 | 0.78669 | 773.000 | B Tailored |

Epitope Coverage of USA B Clade p24

| n m | Coverage | Extras | Vaccine evaluated against data set |
|---|---|---|---|
| 1 1 | 0.73131 | 59.979 | M EpiGraph |
| 2 2 | 0.84204 | 214.296 | M EpiGraph |
| 1 1 | 0.76421 | 52.646 | B EpiGraph |
| 2 2 | 0.87373 | 201.233 | B EpiGraph |
| 2 3 | 0.88878 | 194.434 | B Tailored |
| 3 3 | 0.90810 | 297.571 | B Tailored |
| 2 4 | 0.89779 | 190.635 | B Tailored |
| 3 4 | 0.91754 | 282.386 | B Tailored |
| 2 5 | 0.90461 | 191.794 | B Tailored |

-continued

| n m | Coverage | Extras | Vaccine evaluated against data set |
|-----|----------|---------|-----------------------------------|
| 3 5 | 0.92704 | 285.005 | B Tailored |
| 2 6 | 0.90859 | 187.889 | B Tailored |
| 3 6 | 0.93556 | 280.704 | B Tailored |

Example 10: Vaccine Testing

The vaccine arms for initial testing in CMV include: 1) A single population episensus Gag antigen, central to the U.S. B clade epidemic; 2) The population episensus plus a tailored Gag protein selected to be a best match natural HIV-1 strain; 3) The population episensus plus a tailored Gag protein selected to be a best match different (and distant) natural HIV-1 strain; 4) The population episensus plus both Gag proteins from cohort 2 and 3. The resulting immune responses are analyzed using overlapping 15-mer peptides (4 amino acid overlap) corresponding to the vaccine antigen (to determine the total vaccine-elicited Gag-specific responses) and then to both the "target" HIV-1 strain and selected non-target HIV strains (see below) to measure the strain-specific responses and the level of epitope matching (comparing target vs. non-target HIV Gag sequences). It is determined whether computationally designed inserts and vector combinations provide higher magnitude and broader T cell responses to the target strain, while minimizing non-target strain matched responses. The results of this analysis allow for experimentally testing the predictions for epitope matching generated in Example 1.

Four cohorts of 5 Rhesus Macaques (RM) are inoculated with $10^6$ PFU of HCMV vectors as follows: cohort 1 receives a single vector containing the clade B episensus sequence, cohort 2 receives the episensus vector plus a single tailored vaccine vector, cohort 3 receives the episensus plus a different tailored vaccine vector and cohort 4 receives the episensus plus both tailored vaccine vectors. The vaccines are "tailored" towards 2 representative transmitted/founder HIV strains selected from a small set of 9 B clade U.S. HIV infections that were extensively sequenced longitudinally; this panel represents a spectrum of natural infection comparable to what might be encountered in a human clinical trial. In essence, these 2 divergent natural strains are being used as prototype patients. The episensus/tailored vaccine insert pair that is optimized for one will be suboptimal for the other and vice versa, allowing—via determination of cross-recognition to peptide sets reflecting each strain's specific sequence—reciprocal analysis of whether there is a benefit to our tailored sequence matching strategy. In addition to this reciprocal analysis, the sequence from the other 7 infections will vary in their relative "match" to the selected vaccine vector insert(s), and by analyzing the responses to peptide sets reflecting the sequences of these other 7 HIV strains, the relationship between vector insert sequence and vector combination on magnitude and breadth of matched vs. unmatched responses will be comprehensively analyzed. Part of the motivation for focusing on this set of 9 strains is that carefully sequenced full length genomes are available from longitudinal samples. The isolates are also available as infectious molecular clones, which may be useful for assessing responses in subsequent human studies. Thus by doing the groundwork in RM using this set, there will be a particularly useful matched set of proteins for direct comparisons between macaque and human responses when these vaccines are advanced into human studies.

Rhesus monkeys (RM) are inoculated subcutaneously at day 0 and week 12 and followed longitudinally for one year. Since vaccination by HCMV-vectors is not affected by pre-existing anti-RhCMV immunity, animals naturally infected with RhCMV are used for these experiments. Flow cytometric intracellular cytokine analysis (ICS) is used to determine the CD4+ and CD8+ T cell response to individual consecutive 15mer peptides comprising the vaccine sequences within the vaccine inserts administered to each animal (which will comprise the total vaccine-elicited responses). It is then determined whether these epitope-specific T cells recognize epitope variants in both the target strain and the other 8 non-target strains. For peptides that show responses to strain-specific epitopes, the magnitude, functional avidity, and functional characteristics (IFN-γ, TNF-α, IL-2 and MIP-1β production and CD107 externalization) of these responses to the "parent" (vaccine insert sequences) peptide variants are compared to determine the degree of functional cross-reactivity. In selected cases, truncation analysis is used to identify the core epitope for similar comparative analysis. To determine the percentage of MHC-II restricted CD8+ T cells present, "blocking" mAbs specific for MHC-I and MHC-II, and the invariant chain-derived, MHC-II-specific binding peptide CLIP is used to inhibit influenza-specific CD8+ T cell responses in PBMC, as has been done previously for SIV responses.

Regardless of the T cell priming results related to vector-specific genes, the immunological analysis allows for testing the hypothesis that T cells induced by tailored vaccines are superior with respect to epitope coverage of a given natural HIV reservoir compared to non-tailored vaccines. The tailored 2 antigen cocktail could likely generate T cell responses with at least 25% higher frequency of cross-reactive responses to its matched natural strain compared to episensus alone (Table 5). Testing is also done to determine whether inclusion of 3 complementary tailored antigens in a cocktail induces more cross-reactivity, or if antigen dilution or the presence of greater numbers of vaccine-specific epitopes necessitated by adding 3 instead of 2 antigens actually diminishes the magnitude or breadth of the cross reactive response to the natural protein. CMV-based T cell responses are expected to be much broader and therefore cover a much higher percentage of sequences than reported previously for other vectors. Thus, even with a relatively small number of animals there should be sufficient epitope responses to evaluate the impact of sequence variation on the cross-reactive potential of the responses. The number and magnitude of all responses to the vaccines is determined by using vaccine-matched sets of peptides. Once the targeted peptides are determined, using just those peptides that are positive in each animal, the impact of natural variation on each vaccine-responsive peptide is determined. The natural variants that are tested are based on the variation found in a reference panel, including both tailored and poorly matched Gags. Nonparametric and computational re-sampling statistical methods are used as the primary tools to evaluate the impact of epitope variation on diminishing magnitude or abrogation of recognition. These analyses are complemented, however, by using generalized linear models as needed to explore the impact of more complex interactions on T cell response cross-reactivity.

```
SEQ ID NO: 691
Tailored vaccine antigen episensus sequence.
MGARASVLSGGELDRWEKIRLRPGGKKKYKLKHIVWASRELERFAVNPGLLETSEGCRQILGQLQPSLQTGS
```

EELKSLYNTVATLYCVHQKIEVKDTKEALDKIEEEQNKSKKKAQQ-------AAADTGNSS---------

QVSQNYPIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGEIYKRWIILGLNKIVRMYSPTSI

LDIRQGPKEPFRDYVDRFYKTLRAEQASQEVKNWMTETLLVQNANPDCKTILKALGPAATLEEMMTACQGVGGPGHKA

RVLAEAMSQVTN--SATIMMQRGNFRNQRKTVKCFNCGKEGHIARNCRAPRKKGCWKCGKEGHQMKDC--

TERQANFLGKIWPSH-KGRPGNFLQ--------SRPEPT--------APPEESFRFGEETTTPS-------------

QKQEPIDKE-----LYP-LASLRSLFGNDPSSQ

SEQ ID NO: 692
Tailored vaccine antigen 1 sequence.
MGARASVLSGGELDKWEKIRLRPGGKKKYRLKHIVWASRELERFAVNPGLLETSGGCRQILEQLQPSLQTGS

EELRSLYNTVATLYCVHQKIDVKDTKEALEKIEEEQNKSKKKAQQ-----AAAAADTGNNS---------

QVSQNYPIVQNMQGQMVHQALSPRTLNAWVKVIEEKAFSPEVIPMFTALSEGATPQDLNTMLNSVGGHQAAMQMLKET

INEEAAEWDRVHPVHAGPVAPGQMREPRGSDIAGTTSTLQEQIGWMTSNPPIPVGEIYKRWIIMGLNKIVRMYSPTSI

LDIKQGPKEPFRDYVDRFYKTLRAEQATQEVKNWMTETLLVQNSNPDCKTILKALGPGATLEEMMTACQGVGGPSHKA

RVLAEAMSQATN--SATIMMQKGNFRNQRKIVKCFNCGKEGHIAKNCRAPRKKGCWKCGREGHQMKDC--

TERQVNFLGKIWPSH-KGRPGNFLQ--------NRPEPT-----------APPAESFRFGEETTTPP----------

QKQEPIDKE-----LYP-LASLKSLFGNDPSSQ

SEQ ID NO: 693
Tailored vaccine antigen 2 sequence.
MGARASVLSGGKLDKWEKIRLRPGGKKRYKLKHIVWASRELERFAVNPGLLETAEGCRQILGQLQPALQTGS

EELKSLFNTVATLYCVHQRIDVKDTKEALEKIEEEQNKSKKKAQP------AAADTGSSS----------

QVSQNYPIVQNMQGQMVHQAISPRTLNAWVKVIEEKAFSPEVIPMFAALSEGATPQDLNLMLNTVGGHQAAMQMLKET

INEEAAEWDRLHPVHAGPVAPGQMREPRGSDIAGTTSTLQEQIGWMTHNPPIPVGEIYKKWIIMGLNKIVRMYSPTSI

LDIKQGPKEPFRDYVDRFYKTLRAEQATQEVKNWMTETLLVQNSNPDCKTILKALGPGATLEEMMTACQGVGGPSHKA

RVLAEAMSQATN--SATIMMQRGNFKNQRKTIKCFNCGKEGHIAKNCRAPRKKGCWKCGREGHQMKDC--

TERQANFLGKIWPSH-KGRPGNFLQ--------NRPEPT-----------APPAESFRFGEETTTPP----------

QKQEPIDKE-----LYP-LASLKSLFGNDPSSQ

SEQ ID NO: 694
Tailored vaccine antigen 3 sequence.
MGARASVLSGGELDKWEKIRLRPGGKKKYRLKHIVWASRELERFAVNPGLLETAEGCRQILEQLQPSLQTGS

EELRSLYNTVAVLYCVHQRIDVKDTKEALDKIEEEQNKSKKKAQQ-----AAAAADTGNNS---------

QVSQNYPIVQNLQGQMVHQPISPRTLNAWVKVIEEKAFSPEVIPMFTALSEGATPQDLNTMLNTVGGHQAAMQMLKDT

INEEAAEWDRLHPVQAGPIAPGQIREPRGSDIAGTTSTLQEQIAWMTNNPPIPVGDIYKRWIILGLNKIVRMYSPTSI

LDIKQGPKEPFRDYVDRFYKTLRAEQASQDVKNWMTETLLVQNSNPDCKTILKALGPGATLEEMMTACQGVGGPSHKA

RVLAEAMSQATN--SATIMMQKGNFRNQRKIVKCFNCGKEGHIAKNCRAPRKKGCWKCGREGHQMKDC--

TERQANFLGKIWPSS-KGRPGNFLQ--------SRPEPT-----------APPAESFRFGEETTTPP----------

QKQEPIDKE-----LYP-LASLKSLFGNDPSSQ

SEQ ID NO: 695
Tailored vaccine antigen 4 sequence.
MGARASVLSGGKLDKWEKIRLRPGGKKKYRLKHIVWASRELERFAVNPGLLETAEGCRQILGQLQPALQTGS

EELRSLYNTVATLYCVHQRIEVKDTKEALEKIEEEQNKSKKKVQQ------AAAADTGNSN---------

QVSQNYPIVQNIQGQMVHQPLSPRTLNAWVKVIEEKAFSPEVIPMFTALSEGATPQDLNTMLNTIGGHQAAMQMLKET

INEEAADWDRLHPVHAGPVAPGQMREPRGSDIAGTTSNLQEQIGWMTSNPPIPVGEIYKRWIIMGLNKIVRMYSPTSI

LDIKQGPKEPFRDYVDRFYKTLRAEQASQDVKNWMTETLLVQNSNPDCKTILKALGPGATLEEMMTACQGVGGPSHKA

RVLAEAMSQVTN--SATIMMQKGNFRNQRKIVKCFNCGKEGHIAKNCRAPRKRGCWKCGKEGHQMKEC--

TERQANFLGKIWPSY-KGRPGNFLQ--------SRPEPS-----------APPEESFRFGEETATPS----------

QKQEPIDKE-----LYP-LASLKSLFGNDPSSQ

SEQ ID NO: 696
Tailored vaccine antigen 5 sequence.
    MGARASVLSGGKLDKWEKIRLRPGGKKQYKLKHLVWASRELERFAVNPGLLETAEGCRQILGQLQPALQTGS

EELKSLFNTVATLYCVHQRIDVKDTKEALEKIEEEQNKSKKKAQQ-------AAADTGNNS---------

QVSQNYPIVQNIQGQMVHQALSPRTLNAWVKVIEEKAFSPEVIPMFSALAEGATPQDLNTMLNTVGGHQAAMQILKET

INEEAAEWDRLHPVQAGPVAPGQMREPRGSDIAGTTSNLQEQIAWMTHNPPIPVGETYKRWIIMGLNKIVRMYSPVSI

LDIRQGPKEPFRDYVDRFYKTLRAEQASQDVKNWMTETLLVQNSNPDCKTILKALGPGATLEEMMTACQGVGGPSHKA

RVLAEAMSQATN--PATIMMQRGNFKNQRKIVKCFNCGKEGHIAKNCRAPRKKGCWKCGKEGHQMKEC--

TERQANFLGKIWPSY-KGRPGNFLQ--------SRPEPS-----------APPEESFRFGEETTTPP----------

QKQEPIDKE-----LYP-LTSLRSLFGNDPSSQ

SEQ ID NO: 697
EpiGraph antigen 1 sequence.
MGARASVLSGGELDRWEKIRLRPGGKKKYKLKHIVWASRELERFAVNPGLLETSEGCRQILGQLQPSLQTGS

EELKSLYNTVATLYCVHQRIDVKDTKEALDKIEEEQNKSKKKAQQ-------AAADTGNSS---------

QVSQNYPIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGETYKRWIILGLNKIVRMYSPTSI

LDIRQGPKEPFRDYVDRFYKTLRAEQASQEVKNWMTETLLVQNANPDCKTILKALGPAATLEEMMTACQGVGGPGHKA

RVLAEAMSQVTN--SATIMMQRGNFRNQRKTVKCFNCGKEGHIARNCRAPRKKGCWKCGKEGHQMKDC--

TERQANFLGKIWPSH-KGRPGNFLQ--------SRPEPT-----------APPEESFRFGEETTTPS----------

QKQEPIDKE-----LYP-LASLRSLFGNDPSSQ

SEQ ID NO: 698

Epigraph cocktail antigen 1.

MGARASVLSGGELDRWEKIRLRPGGKKKYKLKHIVWASRELERFAVNPGLLETSEGCRQILGQLQPSLQTGS

EELKSLYNTVATLYCVHQRIDVKDTKEALDKIEEEQNKSKKKAQQ-------AAADTGNSS---------

QVSQNYPIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGETYKRWIILGLNKIVRMYSPTSI

LDIRQGPKEPFRDYVDRFYKTLRAEQASQEVKNWMTETLLVQNANPDCKTILKALGPAATLEEMMTACQGVGGPGHKA

RVLAEAMSQVTN--SATIMMQRGNFRNQRKTVKCFNCGKEGHIARNCRAPRKKGCWKCGKEGHQMKDC--

TERQANFLGKIWPSH-KGRPGNFLQ--------SRPEPT-----------APPEESFRFGEETTTPS----------

QKQEPIDKE-----LYP-LASLRSLFGNDPSSQ

SEQ ID NO: 699
Epigraph cocktail antigen 2.
MGARASVLSGGKLDKWEKIRLRPGGKKKYRLKHIVWASRELERFALNPGLLETAEGCRQILGQLQPALQTGS

EELKSLFNTVATLYCVHQKIDVKDTKEALEKIEEEQNKSKKKAQQ-----AAAAADTGNNS---------

QVSQNYPIVQNMQGQMVHQALSPRTLNAWVKVIEEKAFSPEVIPMFTALSEGATPQDLNLMLNTVGGHQAAMQILKET

INEEAADWDRLHPVHAGPVAPGQMREPRGSDIAGTTSNLQEQIGWMTSNPPIPVGETYKRWIIMGLNKIVRMYSPVSI

LDIKQGPKEPFRDYVDRVYKTLRAEQASQDVKNWMTETLLVQNSNPDCKTILKALGPGATLEEMMTACQGVGGPSHKA

RVLAEAMSQATN--SATIMMQKGNFRNQRKIVKCFNCGKEGHIAKNCRAPRKRGCWKCGKEGHQMKEC--

```
TERQANFLGKIWPSY-KGRPGNFLQ--------NRPEPT-----------APPAESFRFGEETTTPP----------

QKQEPIDKE-----LYP-LASLKSLFGNDPSSQ
```

SEQ ID NO: 700
Epigraph cocktail antigen 3.
```
        ARASVLSGGELDKWEKIRLRPGGKKQYKLKHLVWASRELERFAINPGLLETSGGCRQILEQLQPSLQTGSEE

LRSLYNTVAVLYCVHQRIEVKDTKEALEKVEEEQNKSKKKVQQ-------AAADTGNSN---------

QVSQNYPIVQNIQGQMVHQPISPRTLNAWVKVIEDKAFSPEVIPMFAALSEGATPQDLNTMLNTIGGHQAAMQMLKDT

INEEAAEWDRLHPVQAGPVAPGQMRDPRGSDIAGTTSTLQEQIAWMTNNPPIPVGDIYKRWIILGLNKIVRMYSPTSI

LDIKQGPKESFRDYVDRFYKTLRAEQATQEVKNWMTETLLVQNANPDCRTILKALGPAATLEEMMSACQGVGGPSHKA

RILAEAMSQVTN--

STAIMMQRGNFKNQRKTVKCFNCGREGHIAKNCRAPRKKGCWKCGREGHQMKDCTERQRQANFLGKIWPSS-

KGRPGNFLQ--------SRPEPS-----------APPEESFRFGEETATPS----------QKQEPIDKE-----

LYP-LTSLRSLFGNDPSLQ
```

SEQ ID NO: 701
HIV B gag/nef fusion Epigraph 1
```
        MGARASVLSGGELDRWEKIRLRPGGKKKYRLKHIVWASRELERFAVNPGLLETSEGCRQILGQLQPSLQTGS

EELKSLYNTVATLYCVHQRIEVKDTKEALDKIEEEQNKSKKKAQQAAADTGNSSQVSQNYPIVQNLQGQMVHQAISPR

TLNAWVKVVEEKAFSPEVIPMFSALSEGATPQDLNTMLNTVGGHQAAMQMLKETINEEAAEWDRLHPVHAGPIAPGQM

REPRGSDIAGTTSTLQEQIGWMTNNPPIPVGEIYKRWIILGLNKIVRMYSPTSILDIRQGPKEPFRDYVDRFYKTLRA

EQASQEVKNWMTETLLVQNANPDCKTILKALGPAATLEEMMTACQGVGGPGHKARVLAEAMSQVTNSATIMMQRGNFR

NQRKTVKCFNCGKEGHIAKNCRAPRKKGCWKCGKEGHQMKDCTERQANFLGKIWPSHKGRPGNFLQSRPEPTAPPEES

FRFGEETTTPSQKQEPIDKELYPLASLKSLFGNDPSSQGGKWSKSSIVGWPAVRERMRRAEPAAEGVGAVSRDLEKHG

AITSSNTAATNADCAWLEAQEEEEVGFPVRPQVPLRPMTYKGALDLSHFLKEKGGLEGLIYSQKRQDILDLWVYHTQG

YFPDWQNYTPGPGIRYPLTFGWCFKLVPVEPEKVEEANEGENNSLLHPMSQHGMDDPEKEVLMWKFDSRLAFHHMARE

LHPEYYKDC
```

SEQ ID NO: 702
HIV B gag/nef fusion Epigraph 2
```
        MGARASVLSGGKLDKWEKIRLRPGGKKKYKLKHIVWASRELERFALNPGLLETSEGCKQILGQLQPALQTGS

EELRSLYNTVAVLYCVHQRIDVKDTKEALEKIEEEQNKCKKKAQQAAAAADTGNNSQVSQNYPIVQNMQGQMVHQALS

PRTLNAWVKVIEEKAFSPEVIPMFTALSEGATPQDLNTMLNTIGGHQAAMQMLKDTINEEAAEWDRVHPVHAGPVAPG

QMREPRGSDIAGTTSNLQEQIAWMTHNPPIPVGEIYKRWIIMGLNKIVRMYSPVSILDIKQGPKEPFRDYVDRFYRTL

RAEQASQDVKNWMTETLLVQNSNPDCKTILKALGPGATLEEMMTACQGVGGPSHKARVLAEAMSQVTNSATIMMQKGN

FRNQRKIVKCFNCGKEGHIARNCRAPRKRGCWKCGKEGHQMKECTERQANFLGKIWPSYKGRPGNFLQNRPEPTAPPA

ESFRFGEETATPPQKQEPIDKEMYPLASLRSLFGNDPSQGGKWSKRSVPGWNTIRERMRRTEPAAEGVGAASRDLERH

GAITSSNTAANNAACAWLEAQEDEEVGFPVKPQVPLRPMTYKAAVDLSHFLKEKGGLEGLIHSQKRQEILDLWVYNTQ

GYFPDWHNYTPGPGTRFPLTFGWCFKLVPVDPEQVEKANEGENNCLLHPMSLHGMDDPEREVLVWKFDSRLAFHHVAR

EKHPEYYKDC
```

SEQ ID NO: 703
HIV B pol Epigraph 1
```
        MFFRENLAFPQGKAREFSSEQTRANSPTRRELQVWGRDNNSLSEAGADRQGTVSFSFPQITLWQRPLVTIKI

GGQLKEALLADDTVLEEMNLPGRWKPKMIGGIGGFIKVRQYDQIPIEICGHKAIGTVLVGPTPVNIIGRNLLTQIGCT

LNFPISPIETVPVKLKPGMDGPKVKQWPLTEEKIKALVEICTEMEKEGKISKIGPENPYNTPVFAIKKKDSTKWRKLV

DFRELNKRTQDFWEVQLGIPHPAGLKKKKSVTVLDVGDAYFSVPLDKDFRKYTAFTIPSINNETPGIRYQYNVLPQGW

KGSPAIFQSSMTKILEPFRKQNPDIVIYQLYVGSDLEIGQHRTKIEELRQHLLRWGFTTPDKKHQKEPPFLWMGYELH
```

PDKWTVQPIVLPEKDSWTVNDIQKLVGKLNWASQIYAGIKVKQLCKLLRGTKALTEVVPLTEEAELELAENREILKEP

VHGVYYDPSKDLIAEIQKQGQGQWTYQIYQEPFKNLKTGKYARMRGAHTNDVKQLTEAVQKIATESIVIWGKTPKFKL

PIQKETWEAWWTEYWQATWIPEWEFVNTPPLVKLWYQLEKEPIVGAETFYVDGAANRETKLGKAGYVTDRGRQKVVSL

TDTTNQKTQAIHLALQDSGLEVNIVTDSQYALGIIQAQPDKSESELVSQIIEQLIKKEKVYLAWVPAHKGIGGNEQVD

KLVSAGIRKVLFLDGIDKAQEEHEKYHSNWRAMASDFNLPPVVAKEIVASCDKCQLKGEAMHGQVDCSPGIWQLCTHL

EGKIILVAVHVASGYIEAEVIPAETGQETAYFLLKLAGRWPVKTIHTNGSNFTSTTVKAACWWAGIKQEFGIPYNPQS

QGVVSMNKELKKIIGQVRDQAEHLKTAVQMAVFIHNFKRKGGIGGYSAGERIVDIIATDIQTKELQKQITKIQNFRVY

YRDSRDPLWKGPAKLLWKGEGAVVIQDNSDIKVVPRRKAKIIRDYGKQMAGDDCVASRQDED

SEQ ID NO: 704
HIV B pol Epigraph 2
MFFREDLAFPQGEAREFPSEQTRANSPTSRELQVWGGDNNSPSEAGADRQGTVSLSFPQITLWQRPLVTVKI

GGQLKEALLADDTVLEEMSLPGKWKPKMIGGIGGFIKVRQYDQVPIEICGHKTIGTVLIGPTPVNIIGRNLLTQLGCT

LNFPISPIETVPVKLKPGMDGPRVKQWPLTEEKIKALIEICTEMEKEGKISRIGPENPYNTPIFAIKKKDSTKWRKLV

DFRELNKKTQDFWEVQLGIPHPSGLKKKKSVTVLDVGDAYFSVPLDKEFRKYTAFTIPSTNNETPGIRYQYNVLPQGW

KGSPAIFQCSMTKILEPFRKQNPEIVIYQLYVGSDLEIGQHRAKIEELRQHLLKWGFTTPDKKHQKEPPFLWMGYELH

PDKWTVQPIELPEKDSWTVNDIQKLVGKLNWASQIYPGIKVRQLCKLLRGAKALTEVIPLTKEAELELAENREILREP

VHGVYYDPTKDLIAEIQKQGLGQWTYQIYQEPFKNLKTGKYARTRGAHTNDVRQLTEAVQKITTESIVIWGKTPKFRL

PIQKETWETWWTEYWQATWIPEWEFVNTPPLVKLWYQLEKEPIIGAETFYVDGASNRETKLGKAGYVTNRGRQKVISL

TDTTNQKTLQAIYLALQDSGSEVNIVTDSQYALGIIQAQPDQSESELVNQIIEQLINKEKVYLAWVPAHKGIGGNEQV

DKLVSTGIRKVLFLDGIDRAQEEHEKYHNNWRAMASDFNLPPIVAKEIVASCDKCQLKGEAIHGQVDCSPGIWQLCTH

LEGKVILVAVHVASGYIEAEVIPAETGQETAYFILKLAGRWPVKTVHTNGSNFTSATVKAACWWAGVKQEFGIPYNPQ

SQGVVSMNNELKKIIGQIRDQAEHLKTAVQMAVFIHNFKRKGGIGEYSAGERIIDIIATDIQTRELQKQITKIQNFRV

YYRDNRDPLWKGPAKLLWKGEGAVVIQDNSEIKVVPRRKVKIIRDYGKQMAGDDCVAGRQDED

SEQ ID NO: 705
HIV M gag/nef fusion Epigraph 1
MGARASVLSGGKLDAWEKIRLRPGGKKKYRLKHLVWASRELERFALNPGLLETSEGCRQILGQLQPSLQTGS

EELKSLYNTVATLYCVHQRIEVKDTKEALDKIEEEQNKSKKKAQQAAADTGNSSQVSQNYPIVQNLQGQMVHQAISPR

TLNAWVKVVEEKAFSPEVIPMFSALSEGATPQDLNTMLNTVGGHQAAMQMLKETINEEAAEWDRLHPVHAGPIAPGQM

REPRGSDIAGTTSTLQEQIGWMTNNPPIPVGEIYKRWIILGLNKIVRMYSPVSILDIRQGPKEPFRDYVDRFYKTLRA

EQATQEVKNWMTETLLVQNANPDCKTILKALGPAATLEEMMTACQGVGGPGHKARVLAEAMSQVTNSATIMMQRGNFK

GQKRIKCFNCGKEGHIARNCRAPRKKGCWKCGKEGHQMKDCTERQANFLGKIWPSHKGRPGNFLQSRPEPTAPPEESF

RFGEETTTPSQKQEPIDKELYPLASLKSLFGNDPLSQGGKWSKSSIVGWPAVRERMRRAEPAAEGVGAVSRDLEKHGA

ITSSNTAATNADCAWLEAQEEEEVGFPVRPQVPLRPMTYKGALDLSHFLKEKGGLEGLIYSKKRQEILDLWVYHTQGY

FPDWQNYTPGPGIRYPLTFGWCFKLVPVDPREVEEANEGENNCLLHPMSQHGMDDPEKEVLMWKFDSRLAFHHMAREL

HPEYYKDC

SEQ ID NO: 706
HIV M gag/nef conserved Epigraph 1
MPIVQNLQGQMVHQAISPRTLNAWVKVVEEKAFSPEVIPMFSALSEGATPQDLNTMLNTVGGHQAAMQMLKE

TINEEAAEWDRLHPVHAGPIAPGQMREPRGSDIAGTTSTLQEQIGWMTNNPPIPVGEIYKRWIILGLNKIVRMYSPVS

ILDIRQGPKEPFRDYVDRFYKTLRAEQATQEVKNWMTETLLVQNANPDCKTILKALGPAATLEEMMTACQGVGGPGHK

ARVLVGFPVRPQVPLRPMTYKGALDLSHFLKEKGGLEGLIYSKKRQEILDLWVYHTQGYFPDWQNYTPGPGIRYPLTF

GWCFKLVP

```
SEQ ID NO: 707
HIV M gag/nef fusion Epigraph 2
     MGARASVLSGGELDRWEKIRLRPGGKKKYKLKHIVWASRELERFAVNPGLLETAEGCQQIIEQLQSTLKTGS

EELKSLFNTVAVLYCVHQRIDVKDTKEALEKIEEEQNKSQQKTQQAAAGTGSSSKVSQNYPIVQNAQGQMVHQPLSPR

TLNAWVKVIEEKAFSPEVIPMFTALSEGATPQDLNMMLNIVGGHQAAMQMLKDTINEEAAEWDRVHPVHAGPIPPGQM

REPRGSDIAGTTSNLQEQIGWMTSNPPIPVGDIYKRWIILGLNKIVRMYSPTSILDIKQGPKEPFRDYVDRFFKTLRA

EQASQEVKNWMTDTLLVQNANPDCKTILRALGPGATLEEMMTACQGVGGPSHKARVLAEAMSQVTNSATIMMQRGNFR

NQRKTVKCFNCGKEGHLARNCRAPRKKGCWKCGREGHQMKDCNERQANFLGKIWPSNKGRPGNFPQSRPEPTAPPAES

FRFEETTPAPKQEPKDREPLTSLKSLFGSDPLSQGSKWSKSSIVGWPAIRERMRRTEPAAEGVGAASRDLERHGAITS

SNTAANNADCAWLEAQEDEEVGFPVKPQVPLRPMTYKAAFDLSFFLKEKGGLDGLIYSQKRQDILDLWVYNTQGFFPD

WQNYTPGPGVRYPLTFGWCFKLVPVEPEKVEEANEGENNSLLHPMSLHGMDDPEREVLMWKFDSSLARRHMARELHPE

FYKDC

SEQ ID NO: 708
HIV M gag/nef conserved Epigraph 2
     MPIVQNAQGQMVHQPLSPRTLNAWVKVIEEKAFSPEVIPMFTALSEGATPQDLNMMLNIVGGHQAAMQMLKD

TINEEAAEWDRVHPVHAGPIPPGQMREPRGSDIAGTTSNLQEQIGWMTSNPPIPVGDIYKRWIILGLNKIVRMYSPTS

ILDIKQGPKEPFRDYVDRFFKTLRAEQASQEVKNWMTDTLLVQNANPDCKTILRALGPGATLEEMMTACQGVGGPSHK

ARVLVGFPVKPQVPLRPMTYKAAFDLSFFLKEKGGLDGLIYSQKRQDILDLWVYNTQGFFPDWQNYTPGPGVRYPLTF

GWCFKLVP

SEQ ID NO: 709
HIV M pol Epigraph 1
     MFFRENLAFPQGEAREFSSEQTRANSPTRRELQVWGRDNNSLSEAGADRQGTVSFSFPQITLWQRPLVTIKI

GGQLKEALLADDTVLEDINLPGKWKPKMIGGIGGFIKVRQYDQILIEICGKKAIGTVLVGPTPVNIIGRNLLTQIGCT

LNFPISPIETVPVKLKPGMDGPKVKQWPLTEEKIKALVEICTEMEKEGKISKIGPENPYNTPVFAIKKKDSTKWRKLV

DFRELNKRTQDFWEVQLGIPHPAGLKKKKSVTVLDVGDAYFSVPLDKDFRKYTAFTIPSINNETPGIRYQYNVLPQGW

KGSPAIFQSSMTKILEPFRKQNPDIVIYQLYVGSDLEIGQHRTKIEELRQHLLKWGFTTPDKKHQKEPPFLWMGYELH

PDKWTVQPIVLPEKDSWTVNDIQKLVGKLNWASQIYPGIKVKQLCKLLRGAKALTDIVPLTEEAELELAENREILKEP

VHGVYYDPSKDLIAEIQKQGQDQWTYQIYQEPFKNLKTGKYARMRGAHTNDVKQLTEAVQKIATESIVIWGKTPKFRL

PIQKETWETWWTEYWQATWIPEWEFVNTPPLVKLWYQLEKEPIVGAETFYVDGAANRETKLGKAGYVTDRGRQKVVSL

TETTNQKTLQAIHLALQDSGSEVNIVTDSQYALGIIQAQPDKSESELVNQIIEQLIKKEKVYLSWVPAHKGIGGNEQV

DKLVSSGIRKVLFLDGIDKAQEEHEKYHSNWRAMASDFNLPPIVAKEIVASCDKCQLKGEAMHGQVDCSPGIWQLCTH

LEGKVILVAVHVASGYIEAEVIPAETGQETAYFLLKLAGRWPVKVIHTNGSNFTSAAVKAACWWAGIKQEFGIPYNPQ

SQGVVSMNKELKKIIGQVRDQAEHLKTAVQMAVFIHNFKRKGGIGGYSAGERIIDIIATDIQTKELQKQITKIQNFRV

YYRDSRDPIWKGPAKLLWKGEGAVVIQDNSDIKVVPRRKAKIIRDYGKQMAGDDCVAGRQDEDQ

SEQ ID NO: 710
HIV M pol conserved Epigraph 1
     MPQITLWQRPLVTIKIGGQLKEALLADDTVLEDINLPGKWKPKMIGGIGGFIKVRQYDQILIEICGKKAIGT

VLVGPTPVNIIGRNLLTQIGCTLNFPISPIETVPVKLKPGMDGPKVKQWPLTEEKIKALVEICTEMEKEGKISKIGPE

NPYNTPVFAIKKKDSTKWRKLVDFRELNKRTQDFWEVQLGIPHPAGLKKKKSVTVLDVGDAYFSVPLDKDFRKYTAFT

IPSINNETPGIRYQYNVLPQGWKGSPAIFQSSMTKILEPFRKQNPDIVIYQLYVGSDLEIGQHRTKIEELRQHLLKWG

FTTPDKKHQKEPPFLWMGYELHPDKWTVQPIVLPEKDSWTVNDIQKLVGKLNWASQIYHGQVDCSPGIWQLCTHLEGK

VILVAVHVASGYIEAEVIPAETGQETAYFLLKLAGRWPVKVIHTNGSNFTSAAVKAACWWAGIKQEFGIPYNPQSQGV

VSMNKELKKIIGQVRDQAEHLKTAVQMAVFIHNFKRKGGIGGYSAGERIIDIIATDIQTKLQKQITKIQNFRVYYRDS

RDPIWKGPAKLLWKGEGAVVIQDNSDIKVVPRRKAKIIRDYGKQMAGDDCVAGRQDEDQ
```

SEQ ID NO: 711
HIV M pol Epigraph 2
    MFFREDLAFPQGKAREFPSEQTRANSPTRGELQVWGGDNNSPSEAGADRQGTVSFSFPQITLWQRPLVSIKV
GGQIKEALLADDTVLEEMNLPGRWKPKMIGGIGGFIKVRQYDQIPIEICGHKAIGTVLIGPTPVNIIGRNMLTQLGCT
LNFPISPIDTVPVTLKPGMDGPRVKQWPLTEEKIKALTEICKEMEKEGKITKIGPENPYNTPIFAIKKKDSTKWRKLV
DFRELNKKTQDFWEVQLGIPHPAGLKKKKSVTVLDVGDAYFSVPLDESFRKYTAFTIPSTNNETPGIRYQYNVLPQGW
KGSPAIFQCSMTKILEPFRIKNPEIVIYQLYVGSDLEIGQHRAKIEELREHLLRWGFTTPDKKHQKEPPFLWMGYELH
PDRWTVQPIELPEKDSWTVNDIQKLVGKLNWASQIYAGIKVRQLCKLLRGTKALTEVVPLTEEAELELAENREILKTP
VHGVYYDPSKDLVAEIQKQGQGQWTYQIYQEPYKNLKTGKYARKRSAHTNDVRQLTEVVQKIATESIVIWGKTPKFKL
PIQKETWEAWWTDYWQATWIPDWEFVNTPPLVKLWYQLEKDPIVGAETFYVDGAASRETKLGKAGYVTNRGRQKVVSL
TDTTNQKTLHAIHLALQDSGLEVNIVTDSQYALGIIQAQPDRSESEVVNQIIEELIKKEKVYLAWVPAHKGIGGNEQV
DKLVSAGIRKVLFLDGIDKAQEEHERYHSNWRTMASDFNLPPVVAKEIVANCDKCQLKGEAIHGQVDCSPGMWQLCTH
LEGKIILVAVHVASGYMEAEVIPAETGQETAYFILKLAGRWPVKTIHTNGSNFTSTTVKAACWWAGIQQEFGIPYNPQ
SQGVVSMNNELKKIIGQVREQAEHLKTAVQMAVFIHNFKRRGGIGGYSAGERIVDIIATDIQTRELQKQIIKIQNFRV
YYRDSRDPLWKGPAKLLWKGEGAVVIQDNSEIKVVPRRKVKIIKDYGKQMAGDDCVASRQDED SEQ ID NO: 712
HIV M pol conserved Epigraph 2
    MPQITLWQRPLVSIKVGGQIKEALLADDTVLEEMNLPGRWKPKMIGGIGGFIKVRQYDQIPIEICGHKAIGT
VLIGPTPVNIIGRNMLTQLGCTLNFPISPIDTVPVTLKPGMDGPRVKQWPLTEEKIKALTEICKEMEKEGKITKIGPE
NPYNTPIFAIKKKDSTKWRKLVDFRELNKKTQDFWEVQLGIPHPAGLKKKKSVTVLDVGDAYFSVPLDESFRKYTAFT
IPSTNNETPGIRYQYNVLPQGWKGSPAIFQCSMTKILEPFRIKNPEIVIYQLYVGSDLEIGQHRAKIEELREHLLRWG
FTTPDKKHQKEPPFLWMGYELHPDRWTVQPIELPEKDSWTVNDIQKLVGKLNWASQIYHGQVDCSPGMWQLCTHLEGK
IILVAVHVASGYMEAEVIPAETGQETAYFILKLAGRWPVKTIHTNGSNFTSTTVKAACWWAGIQQEFGIPYNPQSQGV
VSMNNELKKIIGQVREQAEHLKTAVQMAVFIHNFKRRGGIGGYSAGERIVDIIATDIQTRLQKQIIKIQNFRVYYRDS
RDPLWKGPAKLLWKGEGAVVIQDNSEIKVVPRRKVKIIKDYGKQMAGDDCVASRQDED SEQ ID NO: 713
SIV gag/nef hybrid
    MGARGSVLSGKKTDELEKVRLRPGGRKKYMLKHIVWAARELDRFGSAESLLESKEGCQRILAVLAPLMPTGS
EDLKSLFSTVCVVWCLHAEMKVKDTEEAKKTVQSHLVVESGTAETMPAQSRPTAPPSGRGGNYPVQQIGGNYVHLPLS
PRTLNAWVKLIEEKKFGAEVVPGFQALSEGCTPYDINQMLNCVGDHQAAMQIIRDIINEEAADWDLQHPQPAPQQGQL
REPSGSDIAGTTSSVDEQIQWMYRQQNPIPVGNIYRRWIQLGLQKCVRMYNPTNILDVKQGPKEPFQSYVDRFYKSLR
AEQTDAAVKNWMTQTLLIQNANPDCKLVLKGLGVNPTLEEMLTACQGVGGPGQKARLMAEALKDALTPGPIPFAAVQQ
RGQRKIIKCWNCGKTGHSARQCKAPRRKGCWKCGKAGHVMAKCPERQAGFLGFGPWGKKPHNFPMAQMPQGLTPTAPP
ADPAVDMLKNYMKMGKRQREKQRENRERPYKEVSEDLLHLSSLFGEDQPGGATSKRRSKPSGDLRQKLLRARGENYGR
LWGELEDGSSQSLGGLGKGLSSRSCEGQKYSQGQFMNTPWKNPAEEKEKLPYRKQNIDDVDEEDNDLVGVSVRPKVPL
RTMSYKLAIDMSHFIKEKGGLEGIYYSARRHRILDIYLEKEEGIIPDWQDYTSGPGIRYPKTFGWLWKLVPVDMSNEA
QEDDTHYLVHPAQTHQWSDPWGEVLVWKFDPLLAHTYEAFVRHPEEFGWKSGLPKEEVERRLAARGLLKMADKKETR SEQ ID NO: 714
SIV gag/nef conserved
    MPVQQIGGNYVHLPLSPRTLNAWVKLIEEKKFGAEVVPGFQALSEGCTPYDINQMLNCVGDHQAAMQIIRDI
INEEAADWDLQHPQPAPQQGQLREPSGSDIAGTTSSVDEQIQWMYRQQNPIPVGNIYRRWIQLGLQKCVRMYNPTNIL -continued

```
DVKQGPKEPFQSYVDRFYKSLRAEQTDAAVKNWMTQTLLIQNANPDCKLVLKGLGVNPTLEEMLTACQGVGGPGQKAR

LMVGVSVRPKVPLRTMSYKLAIDMSHFIKEKGGLEGIYYSARRHRILDIYLEKEEGIIPDWQDYTSGPGIRYPKTFGW

LWKLVP
```

SEQ ID NO: 715
SIV pol hybrid

```
        MFFRAWPMGKEASQFPHGPDASGADTNCSPRGSSCGSTEELHEVGQKAERKAEGEQRETLQGGNGGFAAPQF

SLWRRPVVTAHIEGQPVEVLLADDSIVTGIELGPHYTPKIVGGIGGFINTKEYKNVEIEVLGKRIKGTIMTGDTPINI

FGRNLLTALGMSLNFPIAKVEPVKVALKPGKDGPKLKQWPLSKEKIVALREICEKMEKDGQLEEAPPTNPYNTPTFAI

KKKDKNKWRMLIDFRELNRVTQDFTEVQLGIPHPAGLAKRKRITVLDIGDAYFSIPLDEEFRQYTAFTLPSVNNAEPG

KRYIYKVLPQGWKGSPAIFQYTMRHVLEPFRKANPDVTLVQILIASDRTDLEHDRVVLQSKELLNSIGFSTPEEKFQK

DPPFQWMGYELWPTKWKLQKIELPQRETWTVNDIQKLVGVLNWAAQIYPGIKTKNLCKMIRGKMALTEGVQWTELAEA

ELEENRIILNQEQEGRYYREDKPLEATVLKNQDNQWTYKIHQGDRILKVGKYAKVKNTHTNGIRLLANVVQKIGKESI

VIWGQTPFFHLPVEREVWDQWWTDYWQATWIPDWDFVSTPPLIRLVFNLVKEPIEKEEVYYIDGSCNRNSKEGKAGYV

TDRGKEKVLVLEQATNQQALQAFLLALKDSGPKANIVTDSQYVLGIITGQPTESDSRIVAQIIEQMIKKSEVYIGWVP

AHKGLGGNQEVDRLVSQEIRQVLFLESIEPAQEDHDKYHSNIKELAFKFGLPRLVAKQIVDTCNKCQQKGEAIHGQAN

SDLGTWQMCTHLEGKIIIVAVHVASGFIEAEVIPQETGRQTALFLLKLAGRWPITHLHTNGANFASQEVKMVANWAGI

EHTFGVPYNPQSQGVVAMNHHLKNQIDRIREQANSVETIVLMAVHCMNFKRRGGIGDMTPAERLINMITTEQEIQFQQ

SKNSKFKNFRVYYREGRDQLWKGPGELLWKGEGAVILKVGTDIKVVPRRKAKIIKDYGGGKEVDSSSHMEDTGEAREV

A
```

SEQ ID NO: 716
SIV pol conserved

```
        MPQFSLWRRPVVTAHIEGQPVEVLLADDSIVTGIELGPHYTPKIVGGIGGFINTKEYKNVEIEVLGKRIKGT

IMTGDTPINIFGRNLLTALGMSLNFPIAKVEPVKVALKPGKDGPKLKQWPLSKEKIVALREICEKMEKDGQLEEAPPT

NPYNTPTFAIKKKDKNKWRMLIDFRELNRVTQDFTEVQLGIPHPAGLAKRKRITVLDIGDAYFSIPLDEEFRQYTAFT

LPSVNNAEPGKRYIYKVLPQGWKGSPAIFQYTMRHVLEPFRKANPDVTLVQILIASDRTDLEHDRVVLQSKELLNSIG

FSTPEEKFQKDPPFQWMGYELWPTKWKLQKIELPQRETWTVNDIQKLVGVLNWAAQIYHGQANSDLGTWQMCTHLEGK

IIIVAVHVASGFIEAEVIPQETGRQTALFLLKLAGRWPITHLHTNGANFASQEVKMVANWAGIEHTFGVPYNPQSQGV

VAMNHHLKNQIDRIREQANSVETIVLMAVHCMNFKRRGGIGDMTPAERLINMITTEQEIQFQQSKNSKFKNFRVYYRE

GRDQLWKGPGELLWKGEGAVILKVGTDIKVVPRRKAKIIKDYGGGKEVDSSSHMEDTGEAREVA
```

SEQ ID NO: 717
HIV B pol epigraph1

```
        FFRENLAFPQGKAREFSSEQTRANSPTRRELQVWGRDNNSLSEAGADRQGTVSFSFPQITLWQRPLVTIKIG

GQLKEALLDTGADDTVLEEMNLPGRWKPKMIGGIGGFIKVRQYDQIPIEICGHKAIGTVLVGPTPVNIIGRNLLTQIG

CTLNFPISPIETVPVKLKPGMDGPKVKQWPLTEEKIKALVEICTEMEKEGKISKIGPENPYNTPVFAIKKKDSTKWRK

LVDFRELNKRTQDFWEVQLGIPHPAGLKKKKSVTVLDVGDAYFSVPLDKDFRKYTAFTIPSINNETPGIRYQYNVLPQ

GWKGSPAIFQSSMTKILEPFRKQNPDIVIYQYMDDLYVGSDLEIGQHRTKIEELRQHLLRWGFTTPDKKHQKEPPFLW

MGYELHPDKWTVQPIVLPEKDSWTVNDIQKLVGKLNWASQIYAGIKVKQLCKLLRGTKALTEVVPLTEEAELELAENR

EILKEPVHGVYYDPSKDLIAEIQKQGQGQWTYQIYQEPFKNLKTGKYARMRGAHTNDVKQLTEAVQKIATESIVIWGK

TPKFKLPIQKETWEAWWTEYWQATWIPEWEFVNTPPLVKLWYQLEKEPIVGAETFYVDGAANRETKLGKAGYVTDRGR

QKVVSLTDTTNQKTELQAIHLALQDSGLEVNIVTDSQYALGIIQAQPDKSESELVSQIIEQLIKKEKVYLAWVPAHKG

IGGNEQVDKLVSAGIRKVLFLDGIDKAQEEHEKYHSNWRAMASDFNLPPVVAKEIVASCDKCQLKGEAMHGQVDCSPG

IWQLDCTHLEGKIILVAVHVASGYIEAEVIPAETGQETAYFLLKLAGRWPVKTIHTDNGSNFTSTTVKAACWWAGIKQ
```

-continued

EFGIPYNPQSQGVVESMNKELKKIIGQVRDQAEHLKTAVQMAVFIHNFKRKGGIGGYSAGERIVDIIATDIQTKELQK

QITKIQNFRVYYRDSRDPLWKGPAKLLWKGEGAVVIQDNSDIKVVPRRKAKIIRDYGKQMAGDDCVASRQDED

SEQ ID NO: 718
HIV M gag Epigraph1
    MGARASVLSGGKLDAWEKIRLRPGGKKKYRLKHLVWASRELERFALNPGLLETSEGCRQILGQLQPSLQTGS

EELKSLYNTVATLYCVHQRIEVKDTKEALDKIEEEQNKSKKKAQQAAADTGNSSQVSQNYPIVQNLQGQMVHQAISPR

TLNAWVKVVEEKAFSPEVIPMFSALSEGATPQDLNTMLNTVGGHQAAMQMLKETINEEAAEWDRLHPVHAGPIAPGQM

REPRGSDIAGTTSTLQEQIGWMTNNPPIPVGEIYKRWIILGLNKIVRMYSPVSILDIRQGPKEPFRDYVDRFYKTLRA

EQATQEVKNWMTETLLVQNANPDCKTILKALGPAATLEEMMTACQGVGGPGHKARVLAEAMSQVTNSATIMMQRGNFK

GQKRIKCFNCGKEGHIARNCRAPRKKGCWKCGKEGHQMKDCTERQANFLGKIWPSHKGRPGNFLQSRPEPTAPPEESF

RFGEETTTPSQKQEPIDKELYPLASLKSLFGNDPLSQ

SEQ ID NO: 719
HIV M gag Epigraph1 Conserved
    PIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGEIYKRWIILGLNKIVRMYSPVSI

LDIRQGPKEPFRDYVDRFYKTLRAEQATQEVKNWMTETLLVQNANPDCKTILKALGPAATLEEMMTACQGVGGPGHKA

RVL

SEQ ID NO: 720
HIV M gag Epigraph2
    MGARASVLSGGELDRWEKIRLRPGGKKKYKLKHIVWASRELERFAVNPGLLETAEGCQQIIEQLQSTLKTGS

EELKSLFNTVAVLYCVHQRIDVKDTKEALEKIEEEQNKSQQKTQQAAAGTGSSSKVSQNYPIVQNAQGQMVHQPLSPR

TLNAWVKVIEEKAFSPEVIPMFTALSEGATPQDLNMMLNIVGGHQAAMQMLKDTINEEAAEWDRVHPVHAGPIPPGQM

REPRGSDIAGTTSNLQEQIGWMTSNPPIPVGDIYKRWIILGLNKIVRMYSPTSILDIKQGPKEPFRDYVDRFFKTLRA

EQASQEVKNWMTDTLLVQNANPDCKTILRALGPATLEEMMTACQGVGGPSHKARVLAEAMSQVTNSATIMMQRGNFR

NQRKTVKCFNCGKEGHLARNCRAPRKKGCWKCGREGHQMKDCNERQANFLGKIWPSNKGRPGNFPQSRPEPTAPPAES

FRFEETTPAPKQEPKDREPLTSLKSLFGSDPLSQ

SEQ ID NO: 721
HIV M gag Epigraph2 Conserved
    PIVQNAQGQMVHQPLSPRTLNAWVKVIEEKAFSPEVIPMFTALSEGATPQDLNMMLNIVGGHQAAMQMLKDT

INEEAAEWDRVHPVHAGPIPPGQMREPRGSDIAGTTSNLQEQIGWMTSNPPIPVGDIYKRWIILGLNKIVRMYSPTSI

LDIKQGPKEPFRDYVDRFFKTLRAEQASQEVKNWMTDTLLVQNANPDCKTILRALGPATLEEMMTACQGVGGPSHKA

RVL

SEQ ID NO: 722
HIV M nef Epigraph1
    MGGKWSKSSIVGWPAVRERMRRAEPAAEGVGAVSRDLEKHGAITSSNTAATNADCAWLEAQEEEEVGFPVRP

QVPLRPMTYKGALDLSHFLKEKGGLEGLIYSKKRQEILDLWVYHTQGYFPDWQNYTPGPGIRYPLTFGWCFKLVPVDP

REVEEANEGENNCLLHPMSQHGMDDPEKEVLMWKFDSRLAFHHMARELHPEYYKDC

SEQ ID NO: 723
HIV M nef Epigraph1 Conserved
    VGFPVRPQVPLRPMTYKGALDLSHFLKEKGGLEGLIYSKKRQEILDLWVYHTQGYFPDWQNYTPGPGIRYPL
TFGWCFKLVP SEQ ID NO: 724
HIV M nef Epigraph2
    MGSKWSKSSIVGWPAIRERMRRTEPAAEGVGAASRDLERHGAITSSNTAANNADCAWLEAQEDEEVGFPVKP

QVPLRPMTYKAAFDLSFFLKEKGGLDGLIYSQKRQDILDLWVYNTQGFFPDWQNYTPGPGVRYPLTFGWCFKLVPVEP

EKVEEANEGENNSLLHPMSLHGMDDPEREVLMWKFDSSLARRHMARELHPEFYKDC

```
SEQ ID NO: 725
HIV M nef Epigraph2 Conserved
    VGFPVKPQVPLRPMTYKAAFDLSFFLKEKGGLDGLIYSQKRQDILDLWVYNTQGFFPDWQNYTPGPGVRYPL
TFGWCFKLVP SEQ ID NO: 726
HIV M pol Epigraph1
    FFRENLAFPQGEAREFSSEQTRANSPTRRELQVWGRDNNSLSEAGADRQGTVSFSFPQITLWQRPLVTIKIG

GQLKEALLDTGADDTVLEDINLPGKWKPKMIGGIGGFIKVRQYDQILIEICGKKAIGTVLVGPTPVNIIGRNLLTQIG

CTLNFPISPIETVPVKLKPGMDGPKVKQWPLTEEKIKALVEICTEMEKEGKISKIGPENPYNTPVFAIKKKDSTKWRK

LVDFRELNKRTQDFWEVQLGIPHPAGLKKKKSVTVLDVGDAYFSVPLDKDFRKYTAFTIPSINNETPGIRYQYNVLPQ

GWKGSPAIFQSSMTKILEPFRKQNPDIVIYQYMDDLYVGSDLEIGQHRTKIEELRQHLLKWGFTTPDKKHQKEPPFLW

MGYELHPDKWTVQPIVLPEKDSWTVNDIQKLVGKLNWASQIYPGIKVKQLCKLLRGAKALTDIVPLTEEAELELAENR

EILKEPVHGVYYDPSKDLIAEIQKQGQDQWTYQIYQEPFKNLKTGKYARMRGAHTNDVKQLTEAVQKIATESIVIWGK

TPKFRLPIQKETWETWWTEYWQATWIPEWEFVNTPPLVKLWYQLEKEPIVGAETFYVDGAANRETKLGKAGYVTDRGR

QKVVSLTETTNQKTELQAIHLALQDSGSEVNIVTDSQYALGIIQAQPDKSESELVNQIIEQLIKKEKVYLSWVPAHKG

IGGNEQVDKLVSSGIRKVLFLDGIDKAQEEHEKYHSNWRAMASDFNLPPIVAKEIVASCDKCQLKGEAMHGQVDCSPG

IWQLDCTHLEGKVILVAVHVASGYIEAEVIPAETGQETAYFLLKLAGRWPVKVIHTDNGSNFTSAAVKAACWWAGIKQ

EFGIPYNPQSQGVVESMNKELKKIIGQVRDQAEHLKTAVQMAVFIHNFKRKGGIGGYSAGERIIDIIATDIQTKELQK

QITKIQNFRVYYRDSRDPIWKGPAKLLWKGEGAVVIQDNSDIKVVPRRKAKIIRDYGKQMAGDDCVAGRQDEDQ

SEQ ID NO: 727
HIV M pol Epigraph1 Conserved
    PQITLWQRPLVTIKIGGQLKEALLDTGADDTVLEDINLPGKWKPKMIGGIGGFIKVRQYDQILIEICGKKAI

GTVLVGPTPVNIIGRNLLTQIGCTLNFPISPIETVPVKLKPGMDGPKVKQWPLTEEKIKALVEICTEMEKEGKISKIG

PENPYNTPVFAIKKKDSTKWRKLVDFRELNKRTQDFWEVQLGIPHPAGLKKKKSVTVLDVGDAYFSVPLDKDFRKYTA

FTIPSINNETPGIRYQYNVLPQGWKGSPAIFQSSMTKILEPFRKQNPDIVIYQYMDDLYVGSDLEIGQHRTKIEELRQ

HLLKWGFTTPDKKHQKEPPFLWMGYELHPDKWTVQPIVLPEKDSWTVNDIQKLVGKLNWASQIYHGQVDCSPGIWQLD

CTHLEGKVILVAVHVASGYIEAEVIPAETGQETAYFLLKLAGRWPVKVIHTDNGSNFTSAAVKAACWWAGIKQEFGIP

YNPQSQGVVESMNKELKKIIGQVRDQAEHLKTAVQMAVFIHNFKRKGGIGGYSAGERIIDIIATDIQTKELQKQITKI

QNFRVYYRDSRDPIWKGPAKLLWKGEGAVVIQDNSDIKVVPRRKAKIIRDYGKQMAGDDCVAGRQDEDQ

SEQ ID NO: 728
HIV M pol Epigraph2
    FFREDLAFPQGKAREFPSEQTRANSPTRGELQVWGGDNNSPSEAGADRQGTVSFSFPQITLWQRPLVSIKVG

GQIKEALLDTGADDTVLEEMNLPGRWKPKMIGGIGGFIKVRQYDQIPIEICGHKAIGTVLIGPTPVNIIGRNMLTQLG

CTLNFPISPIDTVPVTLKPGMDGPRVKQWPLTEEKIKALTEICKEMEKEGKITKIGPENPYNTPIFAIKKKDSTKWRK

LVDFRELNKKTQDFWEVQLGIPHPAGLKKKKSVTVLDVGDAYFSVPLDESFRKYTAFTIPSTNNETPGIRYQYNVLPQ

GWKGSPAIFQCSMTKILEPFRIKNPEIVIYQYMDDLYVGSDLEIGQHRAKIEELREHLLRWGFTTPDKKHQKEPPFLW

MGYELHPDRWTVQPIELPEKDSWTVNDIQKLVGKLNWASQIYAGIKVRQLCKLLRGTKALTEVVPLTEEAELELAENR

EILKTPVHGVYYDPSKDLVAEIQKQGQGQWTYQIYQEPYKNLKTGKYARKRSAHTNDVRQLTEVVQKIATESIVIWGK

TPKFKLPIQKETWEAWWTDYWQATWIPDWEFVNTPPLVKLWYQLEKDPIVGAETFYVDGAASRETKLGKAGYVTNRGR

QKVVSLTDTTNQKTELHAIHLALQDSGLEVNIVTDSQYALGIIQAQPDRSESEVVNQIIEELIKKEKVYLAWVPAHKG

IGGNEQVDKLVSAGIRKVLFLDGIDKAQEEHERYHSNWRTMASDFNLPPVVAKEIVANCDKCQLKGEAIHGQVDCSPG

MWQLDCTHLEGKIILVAVHVASGYMEAEVIPAETGQETAYFILKLAGRWPVKTIHTDNGSNFTSTTVKAACWWAGIQQ

EFGIPYNPQSQGVVESMNNELKKIIGQVREQAEHLKTAVQMAVFIHNFKRRGGIGGYSAGERIVDIIATDIQTRELQK

QIIKIQNFRVYYRDSRDPLWKGPAKLLWKGEGAVVIQDNSEIKVVPRRKVKIIKDYGKQMAGDDCVASRQDED
```

SEQ ID NO: 729
HIV M pol Epigraph2 Conserved
    PQITLWQRPLVSIKVGGQIKEALLDTGADDTVLEEMNLPGRWKPKMIGGIGGFIKVRQYDQIPIEICGHKAI

GTVLIGPTPVNIIGRNMLTQLGCTLNFPISPIDTVPVTLKPGMDGPRVKQWPLTEEKIKALTEICKEMEKEGKITKIG

PENPYNTPIFAIKKKDSTKWRKLVDFRELNKKTQDFWEVQLGIPHPAGLKKKKSVTVLDVGDAYFSVPLDESFRKYTA

FTIPSTNNETPGIRYQYNVLPQGWKGSPAIFQCSMTKILEPFRIKNPEIVIYQYMDDLYVGSDLEIGQHRAKIEELRE

HLLRWGFTTPDKKHQKEPPFLWMGYELHPDRWTVQPIELPEKDSWTVNDIQKLVGKLNWASQIYHGQVDCSPGMWQLD

CTHLEGKIILVAVHVASGYMEAEVIPAETGQETAYFILKLAGRWPVKTIHTDNGSNFTSTTVKAACWWAGIQQEFGIP

YNPQSQGVVESMNNELKKIIGQVREQAEHLKTAVQMAVFIHNFKRRGGIGGYSAGERIVDIIATDIQTRELQKQIIKI

QNFRVYYRDSRDPLWKGPAKLLWKGEGAVVIQDNSEIKVVPRRKVKIIKDYGKQMAGDDCVASRQDED

SEQ ID NO: 730
HIV B gag Epigraph1
    MGARASVLSGGELDRWEKIRLRPGGKKKYRLKHIVWASRELERFAVNPGLLETSEGCRQILGQLQPSLQTGS

EELKSLYNTVATLYCVHQRIEVKDTKEALDKIEEEQNKSKKKAQQAAADTGNSSQVSQNYPIVQNLQGQMVHQAISPR

TLNAWVKVVEEKAFSPEVIPMFSALSEGATPQDLNTMLNTVGGHQAAMQMLKETINEEAAEWDRLHPVHAGPIAPGQM

REPRGSDIAGTTSTLQEQIGWMTNNPPIPVGEIYKRWIILGLNKIVRMYSPTSILDIRQGPKEPFRDYVDRFYKTLRA

EQASQEVKNWMTETLLVQNANPDCKTILKALGPAATLEEMMTACQGVGGPGHKARVLAEAMSQVTNSATIMMQRGNFR

NQRKTVKCFNCGKEGHIAKNCRAPRKKGCWKCGKEGHQMKDCTERQANFLGKIWPSHKGRPGNFLQSRPEPTAPPEES

FRFGEETTTPSQKQEPIDKELYPLASLKSLFGNDPSSQ

SEQ ID NO: 731
HIV B gag Epigraph1 Conserved
    PIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGEIYKRWIILGLNKIVRMYSPTSI

LDIRQGPKEPFRDYVDRFYKTLRAEQASQEVKNWMTETLLVQNANPDCKTILKALGPAATLEEMMTACQGVGGPGHKA

RVL

SEQ ID NO: 732
HIV B gag Epigraph2
    MGARASVLSGGKLDKWEKIRLRPGGKKKYKLKHIVWASRELERFALNPGLLETSEGCKQILGQLQPALQTGS

EELRSLYNTVAVLYCVHQRIDVKDTKEALEKIEEEQNKSKKRAQQAAADTGNNSQVSQNYPIVQNMQGQMVHQPISPR

TLNAWVKVIEEKAFSPEVIPMFTALSEGATPQDLNTMLNTVGGHQAAMQILKETINEEAADWDRLHPVHAGPVAPGQM

REPRGSDIAGTTSNLQEQIGWMTSNPPIPVGEIYKRWIIMGLNKIVRMYSPVSILDIKQGPKEPFRDYVDRFYKVLRA

EQASQDVKNWMTETLLVQNSNPDCKTILKALGPGATLEEMMTACQGVGGPSHKARILAEAMSQVTNSATIMMQKGNFR

NQRKIVKCFNCGKEGHIARNCRAPRKKGCWKCGREGHQMKDCNERQANFLGKIWPSYKGRPGNFLQNRPEPTAPPAES

FRFGEETTTPPQKQEPIDKDLYPLASLRSLFGNDPSS

SEQ ID NO: 733
HIV B gag Epigraph2 Conserved
    PIVQNMQGQMVHQPISPRTLNAWVKVIEEKAFSPEVIPMFTALSEGATPQDLNTMLNTVGGHQAAMQILKET

INEEAADWDRLHPVHAGPVAPGQMREPRGSDIAGTTSNLQEQIGWMTSNPPIPVGEIYKRWIIMGLNKIVRMYSPVSI

LDIKQGPKEPFRDYVDRFYKVLRAEQASQDVKNWMTETLLVQNSNPDCKTILKALGPGATLEEMMTACQGVGGPSHKA

RIL

SEQ ID NO: 734
HIV B nef Epigraph1
    MGGKWSKSSIVGWPAVRERMRRAEPAAEGVGAVSRDLEKHGAITSSNTAATNADCAWLEAQEEEEVGFPVRP

QVPLRPMTYKGALDLSHFLKEKGGLEGLIYSQKRQDILDLWVYHTQGYFPDWQNYTPGPGIRYPLTFGWCFKLVPVEP

EKVEEANEGENNSLLHPMSQHGMDDPEKEVLMWKFDSRLAFHHMARELHPEYYKDC

```
SEQ ID NO: 735
HIV B nef Epigraph1 Conserved
    GFPVRPQVPLRPMTYKGALDLSHFLKEKGGLEGLIYSQKRQDILDLWVYHTQGYFPDWQNYTPGPGIRYPLT
FGWCFKLVP SEQ ID NO: 736
HIV B nef Epigraph2
    MGGKWSKSSVVGWPAIRERMRRAEPAADGVGAASRDLERHGAITSSNTAANNAACAWLEAQEDEEVGFPVKP

QVPLRPMTYKAAVDLSHFLKEKGGLEGLIHSQKRQEILDLWVYHTQGFFPDWQNYTPGPGTRFPLTFGWCFKLVPVDP

DKVEEANEGENNCLLHPMSLHGMDDPEREVLVWKFDSRLAFHHVARELHPEYYKNC

SEQ ID NO: 737
HIV B nef Epigraph2 Conserved
GFPVKPQVPLRPMTYKAAVDLSHFLKEKGGLEGLIHSQKRQEILDLWVYHTQGFFPDWQNYTPGPGTRFPLTFGWCFK
LVP SEQ ID NO: 738
HIV B pol Epigraph1
    FFRENLAFPQGKAREFSSEQTRANSPTRRELQVWGRDNNSLSEAGADRQGTVSFSFPQITLWQRPLVTIKIG

GQLKEALLDTGADDTVLEEMNLPGRWKPKMIGGIGGFIKVRQYDQIPIEICGHKAIGTVLVGPTPVNIIGRNLLTQIG

CTLNFPISPIETVPVKLKPGMDGPKVKQWPLTEEKIKALVEICTEMEKEGKISKIGPENPYNTPVFAIKKKDSTKWRK

LVDFRELNKRTQDFWEVQLGIPHPAGLKKKKSVTVLDVGDAYFSVPLDKDFRKYTAFTIPSINNETPGIRYQYNVLPQ

GWKGSPAIFQSSMTKILEPFRKQNPDIVIYQYMDDLYVGSDLEIGQHRTKIEELRQHLLRWGFTTPDKKHQKEPPFLW

MGYELHPDKWTVQPIVLPEKDSWTVNDIQKLVGKLNWASQIYAGIKVKQLCKLLRGTKALTEVVPLTEEAELELAENR

EILKEPVHGVYYDPSKDLIAEIQKQGQGQWTYQIYQEPFKNLKTGKYARMRGAHTNDVKQLTEAVQKIATESIVIWGK

TPKFKLPIQKETWEAWWTEYWQATWIPEWEFVNTPPLVKLWYQLEKEPIVGAETFYVDGAANRETKLGKAGYVTDRGR

QKVVSLTDTTNQKTELQAIHLALQDSGLEVNIVTDSQYALGIIQAQPDKSESELVSQIIEQLIKKEKVYLAWVPAHKG

IGGNEQVDKLVSAGIRKVLFLDGIDKAQEEHEKYHSNWRAMASDFNLPPVVAKEIVASCDKCQLKGEAMHGQVDCSPG

IWQLDCTHLEGKIILVAVHVASGYIEAEVIPAETGQETAYFLLKLAGRWPVKTIHTDNGSNFTSTTVKAACWWAGIKQ

EFGIPYNPQSQGVVESMNKELKKIIGQVRDQAEHLKTAVQMAVFIHNFKRKGGIGGYSAGERIVDIIATDIQTKELQK

QITKIQNFRVYYRDSRDPLWKGPAKLLWKGEGAVVIQDNSDIKVVPRRKAKIIRDYGKQMAGDDCVASRQDED

SEQ ID NO: 739
HIV B pol Epigraph1 Conserved
    PQITLWQRPLVTIKIGGQLKEALLDTGADDTVLEEMNLPGRWKPKMIGGIGGFIKVRQYDQIPIEICGHKAI

GTVLVGPTPVNIIGRNLLTQIGCTLNFPISPIETVPVKLKPGMDGPKVKQWPLTEEKIKALVEICTEMEKEGKISKIG

PENPYNTPVFAIKKKDSTKWRKLVDFRELNKRTQDFWEVQLGIPHPAGLKKKKSVTVLDVGDAYFSVPLDKDFRKYTA

FTIPSINNETPGIRYQYNVLPQGWKGSPAIFQSSMTKILEPFRKQNPDIVIYQYMDDLYVGSDLEIGQHRTKIEELRQ

HLLRWGFTTPDKKHQKEPPFLWMGYELHPDKWTVQPIVLPEKDSWTVNDIQKLVGKLNWASQIYHGQVDCSPGIWQLD

CTHLEGKIILVAVHVASGYIEAEVIPAETGQETAYFLLKLAGRWPVKTIHTDNGSNFTSTTVKAACWWAGIKQEFGIP

YNPQSQGVVESMNKELKKIIGQVRDQAEHLKTAVQMAVFIHNFKRKGGIGGYSAGERIVDIIATDIQTKELQKQITKI

QNFRVYYRDSRDPLWKGPAKLLWKGEGAVVIQDNSDIKVVPRRKAKIIRDYGKQMAGDDCVASRQDED

SEQ ID NO: 740
HIV B pol Epigraph2
    FFREDLAFPQGEAREFPSEQTRANSPTRGELQVWGGDNNSPSEAGADRQGTVSLSFPQITLWQRPLVTIKVG

GQLKEALLDTGADDTVLEDMNLPGKWKPKMIGGIGGFIKVRQYDQILIEICGHKAIGTVLIGPTPVNIIGRNLLTQLG

CTLNFPISPIDTVPVKLKPGMDGPRVKQWPLTEEKIKALIEICTEMEKEGKISRIGPENPYNTPIFAIKKKDSTKWRK

LVDFRELNKKTQDFWEVQLGIPHPSGLKKKKSVTVLDVGDAYFSVPLDKEFRKYTAFTIPSTNNETPGIRYQYNVLPQ

GWKGSPAIFQCSMTKILEPFRKQNPEIVIYQYMDDLYVGSDLEIEQHRTKIEELRQHLLKWGFTTPDKKHQKEPPFLW

MGYELHPDKWTVQPIMLPEKDSWTVNDIQKLVGKLNWASQIYPGIKVRQLCKLLRGAKALTEVIPLTEEAELELAENR

EILREPVHGVYYDPTKDLIAEIQKQGLGQWTYQIYQEPYKNLKTGKYARTRGAHTNDVRQLTEAVQKITTESIVIWGK
```

```
TPKFRLPIQKETWETWWTEYWQATWIPEWEFVNTPPLVKLWYQLEKEPIIGAETFYVDGAANRDTKLGKAGYVTNKGR

QKVVTLTDTTNQKTELQAIYLALQDSGSEVNIVTDSQYALGIIQAQPDKSESELVNQIIEQLIKKEKIYLAWVPAHKG

IGGNEQVDKLVSSGIRKVLFLDGIDKAQEDHEKYHSNWKAMASDFNLPPIVAKEIVASCDKCQLKGEAIHGQVDCSPG

IWQLDCTHLEGKVILVAVHVASGYIEAEVIPAETGQETAYFILKLAGRWPVKTVHTDNGSNFTSATVKAACWWAGVKQ

EFGIPYNPQSQGVVESMNNELKKIIGQIRDQAEHLKTAVQMAVFIHNFKRKGGIGGYSAGERIIDIIATDIQTRELQK

QITKIQNFRVYYRDNRDPLWKGPAKLLWKGEGAVVIQDNSEIKVVPRRKVKIIRDYGKQMAGDDCVAGRQDED

SEQ ID NO: 741
HIV B pol Epigraph2 Conserved
        PQITLWQRPLVTIKVGGQLKEALLDTGADDTVLEDMNLPGKWKPKMIGGIGGFIKVRQYDQILIEICGHKAI

GTVLIGPTPVNIIGRNLLTQLGCTLNFPISPIDTVPVKLKPGMDGPRVKQWPLTEEKIKALIEICTEMEKEGKISRIG

PENPYNTPIFAIKKKDSTKWRKLVDFRELNKKTQDFWEVQLGIPHPSGLKKKKSVTVLDVGDAYFSVPLDKEFRKYTA

FTIPSTNNETPGIRYQYNVLPQGWKGSPAIFQCSMTKILEPFRKQNPEIVIYQYMDDLYVGSDLEIEQHRTKIEELRQ

HLLKWGFTTPDKKHQKEPPFLWMGYELHPDKWTVQPIMLPEKDSWTVNDIQKLVGKLNWASQIYHGQVDCSPGIWQLD

CTHLEGKVILVAVHVASGYIEAEVIPAETGQETAYFILKLAGRWPVKTVHTDNGSNFTSATVKAACWWAGVKQEFGIP

YNPQSQGVVESMNNELKKIIGQIRDQAEHLKTAVQMAVFIHNFKRKGGIGGYSAGERIIDIIATDIQTRELQKQITKI

QNFRVYYRDNRDPLWKGPAKLLWKGEGAVVIQDNSEIKVVPRRKVKIIRDYGKQMAGDDCVAGRQDED

SEQ ID NO: 742
HIV C gag Epigraph1
        MGARASILRGGKLDKWEKIRLRPGGKKHYMLKHLVWASRELERFALNPGLLETSEGCKQIMKQLQPALQTGT

EELRSLYNTVATLYCVHEKIEVRDTKEALDKIEEEQNKSQQKTQQAKAADGKVSQNYPIVQNLQGQMVHQAISPRTLN

AWVKVIEEKAFSPEVIPMFTALSEGATPQDLNTMLNTVGGHQAAMQMLKDTINEEAAEWDRLHPVHAGPIAPGQMREP

RGSDIAGTTSTLQEQIAWMTSNPPIPVGDIYKRWIILGLNKIVRMYSPVSILDIKQGPKEPFRDYVDRFFKTLRAEQA

TQDVKNWMTDTLLVQNANPDCKTILRALGPGATLEEMMTACQGVGGPGHKARVLAEAMSQANSNIMMQRSNFKGPKRI

VKCFNCGKEGHIARNCRAPRKKGCWKCGKEGHQMKDCTERQANFLGKIWPSHKGRPGNFLQSRPEPTAPPAEPTAPPA

ESFRFEETTPAPKQEPKDREPLTSLKSLFGSDPLSQ

SEQ ID NO: 743
HIV C gag Epigraph1 Conserved
        PIVQNLQGQMVHQAISPRTLNAWVKVIEEKAFSPEVIPMFTALSEGATPQDLNTMLNTVGGHQAAMQMLKDT

INEEAAEWDRLHPVHAGPIAPGQMREPRGSDIAGTTSTLQEQIAWMTSNPPIPVGDIYKRWIILGLNKIVRMYSPVSI

LDIKQGPKEPFRDYVDRFFKTLRAEQATQDVKNWMTDTLLVQNANPDCKTILRALGPGATLEEMMTACQGVGGPGHKA

RVL

SEQ ID NO: 744
HIV C gag Epigraph2
        MGARASVLRGEKLDKWERIRLRPGGKKRYMLKHIVWASRELEKFALNPGLLETAEGCKQIIKQLHPALQTGT

EELKSLFNTVATLYCVHKKIDVRDTKEALDKIEEEQNKCQQKTQQAEAADGKVSQNYPIVQNLQGQMVHQALSPRTL

NAWVKVVEEKAFSPEIIPMFTALSEGATPTDLNTMLNTVGGHQAAMQMLKDTINEEAAEWDRVHPVHAGPVAPGQMRE

PRGSDIAGTTSNLQEQIAWMTNNPPIPVGEIYKRWIILGLNKIVRMYSPVSILDIRQGPKEPFRDYVDRFFKVLRAEQ

ATQEVKNWMTETLLVQNANPDCKTILRALGPGASLEEMMTACQGVGGPSHKARVLAEAMSQANNANIMMQRSNFKGSK

RIVKCFNCGKEGHIAKNCRAPRKKGCWKCGREGHQMKDCNERQANFLGKIWPSNKGRPGNFLQNRPEPTAPPAEPTAP

PAESFKFEETTPAPKQESKDREPLISLKSLFGNDPLSQ

SEQ ID NO: 745
HIV C gag Epigraph2 Conserved
        PIVQNLQGQMVHQALSPRTLNAWVKVVEEKAFSPEIIPMFTALSEGATPTDLNTMLNTVGGHQAAMQMLKDT INEEAAEWDRVHPVHAGPVAPGQMREPRGSDIAGTTSNLQEQIAWMTNNPPIPVGEIYKRWIILGLNKIVRMYSPVSI
```

LDIRQGPKEPFRDYVDRFFKVLRAEQATQEVKNWMTETLLVQNANPDCKTILRALGPGASLEEMMTACQGVGGPSHKA

RVL

SEQ ID NO: 746
HIV C nef Epigraph1
MGGKWSKSSIVGWPAVRERIRRTEPAAEGVGAASQDLDKYGALTSSNTAHNNADCAWLQAQEEEEVGFPVR

PQVPLRPMTYKAAFDLSFFLKEKGGLEGLIYSKKRQEILDLWVYHTQGFFPDWQNYTPGPGVRYPLTFGWCFKLVPVD

PREVEEANEGENNCLLHPMSQHGMEDEDREVLKWQFDSSLARRHMARELHPEYYKDC

SEQ ID NO: 747
HIV C nef Epigraph1 Conserved
GFPVRPQVPLRPMTYKAAFDLSFFLKEKGGLEGLIYSKKRQEILDLWVYHTQGFFPDWQNYTPGPGVRYPLT
FGWCFKLV SEQ ID NO: 748
HIV C nef Epigraph2
MGSKWSKSSIVGWPAVRERMRRAEPAAEGVGAASRDLDKHGALTSSNTPANNADCAWLEAQEEEGEVGFPVK

PQVPLRPMTYKGAFDLGFFLKEKGGLDGLIYSKKRQDILDLWVYNTQGYFPDWQNYTPGPGIRYPLTFGWCYKLVPVD

PSEVEEANKGENNCLLHPMSLHGMEDEHREVLKWKFDSSLARRHLAREKHPEFYKDC

SEQ ID NO: 749
HIV C nef Epigraph2 Conserved
GFPVKPQVPLRPMTYKGAFDLGFFLKEKGGLDGLIYSKKRQDILDLWVYNTQGYFPDWQNYTPGPGIRYPLT
FGWCYKLV SEQ ID NO: 750
HIV C pol Epigraph1
FFRENLAFPQGEAREFPSEQTRANSPTSRANSPTSRELQVRGDNPRSEAGAERQGTLNFPQITLWQRPLVSI

KVGGQIKEALLDTGADDTVLEEINLPGKWKPKMIGGIGGFIKVRQYDQILIEICGKKAIGTVLVGPTPVNIIGRNMLT

QLGCTLNFPISPIETVPVKLKPGMDGPKVKQWPLTEEKIKALTAICEEMEKEGKITKIGPENPYNTPVFAIKKKDSTK

WRKLVDFRELNKRTQDFWEVQLGIPHPAGLKKKKSVTVLDVGDAYFSVPLDEGFRKYTAFTIPSINNETPGIRYQYNV

LPQGWKGSPAIFQSSMTKILEPFRAQNPEIVIYQYMDDLYVGSDLEIGQHRAKIEELREHLLKWGFTTPDKKHQKEPP

FLWMGYELHPDKWTVQPIQLPEKDSWTVNDIQKLVGKLNWASQIYPGIKVRQLCKLLRGAKALTDIVPLTEEAELELA

ENREILKEPVHGVYYDPSKDLIAEIQKQGHDQWTYQIYQEPFKNLKTGKYAKMRTAHTNDVKQLTEAVQKIAMESIVI

WGKTPKFRLPIQKETWETWWTDYWQATWIPEWEFVNTPPLVKLWYQLEKEPIAGAETFYVDGAANRETKIGKAGYVTD

RGRQKIVSLTETTNQKTELQAIQLALQDSGSEVNIVTDSQYALGIIQAQPDKSESELVNQIIEQLIKKERVYLSWVPA

HKGIGGNEQVDKLVSSGIRKVLFLDGIDKAQEEHEKYHSNWRAMASEFNLPPIVAKEIVASCDKCQLKGEAIHGQVDC

SPGIWQLDCTHLEGKIILVAVHVASGYIEAEVIPAETGQETAYYILKLAGRWPVKVIHTDNGSNFTSAAVKAACWWAG

IQQEFGIPYNPQSQGVVESMNKELKKIIGQVRDQAEHLKTAVQMAVFIHNFKRKGGIGGYSAGERIIDIIATDIQTKE

LQKQIIKIQNFRVYYRDSRDPIWKGPAKLLWKGEGAVVIQDNSDIKVVPRRKVKIIKDYGKQMAGADCVAGRQDEDQ

SEQ ID NO: 751
HIV C pol Epigraph1 Conserved
PQITLWQRPLVSIKVGGQIKEALLDTGADDTVLEEINLPGKWKPKMIGGIGGFIKVRQYDQILIEICGKKAI

GTVLVGPTPVNIIGRNMLTQLGCTLNFPISPIETVPVKLKPGMDGPKVKQWPLTEEKIKALTAICEEMEKEGKITKIG

PENPYNTPVFAIKKKDSTKWRKLVDFRELNKRTQDFWEVQLGIPHPAGLKKKKSVTVLDVGDAYFSVPLDEGFRKYTA

FTIPSINNETPGIRYQYNVLPQGWKGSPAIFQSSMTKILEPFRAQNPEIVIYQYMDDLYVGSDLEIGQHRAKIEELRE

HLLKWGFTTPDKKHQKEPPFLWMGYELHPDKWTVQPIQLPEKDSWTVNDIQKLVGKLNWASQIYHGQVDCSPGIWQLD

CTHLEGKIILVAVHVASGYIEAEVIPAETGQETAYYILKLAGRWPVKVIHTDNGSNFTSAAVKAACWWAGIQQEFGIP

YNPQSQGVVESMNKELKKIIGQVRDQAEHLKTAVQMAVFIHNFKRKGGIGGYSAGERIIDIIATDIQTKELQKQIIKI

QNFRVYYRDSRDPIWKGPAKLLWKGEGAVVIQDNSDIKVVPRRKVKIIKDYGKQMAGADCVAGRQDEDQ

SEQ ID NO: 752
HIV C pol Epigraph2
      FFRENLAFQQGEAREFPSEQARANSPTSRANSPTSRELQVRGDNPCSEAGAERQGTFNFPQITLWQRPLVTI

KVGGQIKEALLDTGADDTVLEDINLPGKWKPRMIGGIGGFIKVRQYDQIPIEICGKKAIGSVLVGPTPVNIIGRNLLT

QLGCTLNFPISPIETIPVKLKPGMDGPRVKQWPLTEEKIKALTEICEEMEKEGKISKIGPENPYNTPIFAIKKKDSTK

WRKLVDFRELNKRTQDFWEVQLGIPHPAGLKKKKSVTVLDVGDAYFSVPLDESFRKYTAFTIPSTNNETPGIRYQYNV

LPQGWKGSPAIFQSSMTRILEPFRAKNPEIVIYQYMDDLYVGSDLEIEQHRAKIEELREHLLRWGFTTPDKKHQKEPP

FLWMGYELHPDKWTVQPIQLPEKESWTVNDIQKLVGKLNWASQIYPGIKVKQLCKLLRGTKALTDIVPLTEEAELELA

ENREILREPVHGVYYDPSKELIAEIQKQGQDQWTYQIYQEPFKNLKTGKYAKRRTAHTNDVRQLTEAVQKIALESIVI

WGKIPKFRLPIQKETWEIWWTDYWQATWIPDWEFVNTPPLVKLWYQLEKEPIAGVETFYVDGAANRETKLGKAGYVTD

KGRQKIVTLTETTNQKAELQAIQLALQDSGPEVNIVTDSQYALGIIQAQPDKSESEIVNQIIEQLINKERIYLSWVPA

HKGIGGNEQVDKLVSNGIRKVLFLDGIDKAQEEHEKYHNNWRAMASDFNLPPVVAKEIVASCDQCQLKGEAMHGQVDC

SPGIWQLDCTHLEGKVILVAVHVASGYMEAEVIPAETGQETAYFILKLAGRWPVKIIHTDNGSNFTSTAVKAACWWAG

IKQEFGIPYNPQSQGVVESMNKELKKIIGQVREQAEHLKTAVQMAVFIHNFKRRGGIGGYSAGERIIDIIASDIQTKE

LQKQITKIQNFRVYYRDSRDPIWKGPAKLLWKGEGAVVLQDNSDIKVVPRRKAKIIRDYGKQMAGDDCVAGRQDED

SEQ ID NO: 753
HIV C pol Epigraph2 Conserved
      PQITLWQRPLVTIKVGGQIKEALLDTGADDTVLEDINLPGKWKPRMIGGIGGFIKVRQYDQIPIEICGKKAI

GSVLVGPTPVNIIGRNLLTQLGCTLNFPISPIETIPVKLKPGMDGPRVKQWPLTEEKIKALTEICEEMEKEGKISKIG

PENPYNTPIFAIKKKDSTKWRKLVDFRELNKRTQDFWEVQLGIPHPAGLKKKKSVTVLDVGDAYFSVPLDESFRKYTA

FTIPSTNNETPGIRYQYNVLPQGWKGSPAIFQSSMTRILEPFRAKNPEIVIYQYMDDLYVGSDLEIEQHRAKIEELRE

HLLRWGFTTPDKKHQKEPPFLWMGYELHPDKWTVQPIQLPEKESWTVNDIQKLVGKLNWASQIYHGQVDCSPGIWQLD

CTHLEGKVILVAVHVASGYMEAEVIPAETGQETAYFILKLAGRWPVKIIHTDNGSNFTSTAVKAACWWAGIKQEFGIP

YNPQSQGVVESMNKELKKIIGQVREQAEHLKTAVQMAVFIHNFKRRGGIGGYSAGERIIDIIASDIQTKELQKQITKI

QNFRVYYRDSRDPIWKGPAKLLWKGEGAVVLQDNSDIKVVPRRKAKIIRDYGKQMAGDDCVAGRQDE

SEQ ID NO: 754
HIV M Gag episensus EG-0, Tailored
      MGARASVLSGGKLDAWEKIRLRPGGKKKYRLKHLVWASRELERFALNPGLLETSEGCRQILGQLQPSLQTGS

EELKSLYNTVATLYCVHQRIEVKDTKEALDKIEEEQNKSKKKAQQAAADTGNSSQVSQNYPIVQNLQGQMVHQAISPR

TLNAWVKVVEEKAFSPEVIPMFSALSEGATPQDLNTMLNTVGGHQAAMQMLKETINEEAAEWDRLHPVHAGPIAPGQM

REPRGSDIAGTTSTLQEQIGWMTNNPPIPVGEIYKRWIILGLNKIVRMYSPVSILDIRQGPKEPFRDYVDRFYKTLRA

EQATQEVKNWMTETLLVQNANPDCKTILKALGPAATLEEMMTACQGVGGPGHKARVLAEAMSQVTNSATIMMQRGNFK

GQKRIKCFNCGKEGHIARNCRAPRKKGCWKCGKEGHQMKDCTERQANFLGKIWPSHKGRPGNFLQSRPEPTAQSRPEP

TAPPAESFRPQPTAPPEESFRFGEETTTPSQKQEPIDKELYPLASLKSLFGNDPLSQY

SEQ ID NO: 755
HIV M gag episensus EG-0 Conserved, Tailored
      PIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGEIYKRWIILGLNKIVRMYSPVSI

LDIRQGPKEPFRDYVDRFYKTLRAEQATQEVKNWMTETLLVQNANPDCKTILKALGPAATLEEMMTACQGVGGPGHKA

RVL

SEQ ID NO: 756
HIV M gag CEN-1, Tailored
      MGARASVLTGGKLDAWERIRLRPGGKKKYRMKHLVWASRELERFAINPGLLETAEGCQQIIEQLQSTLKTGS

EELKSLFNTVATLWCVHQRIEIKDTKEALDKLEEVQNKSQQKTQQAAAGTGSSSKVSQNYPIVQNAQGQMVHQPLSPR

```
TLNAWVKVVEEKGFNPEVIPMFSALSDGATPQDLNMMLNIVGGHQAAMQMLKDTINEEAAEWDRVHPVHAGPIPPGQM

REPRESDIAGTTSNLQEQIGWMTSNPPIPVGDIYKRWIILGLHKIVRMYSPVGILDIKQGPKEPFRDYVDRFFKTLRA

EQASQEVKNWMTETLLIQNANPDCKSILKALGTGATLEEMMTACQGVGGPSHKARVLAEAMSQAQHANIMMQRGNFKG

QRKIKCFNCGKEGHLARNCRAPRKRGCWKCGQEGHQMKDCNERQANFLGKIWPSNKGRPGNFPQSRPEPTAPRTEPTA

PPARPEPTAPPLQSRLEPTAPPAEPTAPPAENWGMGEEITSLLKQEQKDKEHPPPLVSLKSLFGNDPLLQ

SEQ ID NO: 757
HIV M gag CEN-1 Conserved, Tailored
     PIVQNAQGQMVHQPLSPRTLNAWVKVVEEKGFNPEVIPMFSALSDGATPQDLNMMLNIVGGHQAAMQMLKDT

INEEAAEWDRVHPVHAGPIPPGQMREPRESDIAGTTSNLQEQIGWMTSNPPIPVGDIYKRWIILGLHKIVRMYSPVGI

LDIKQGPKEPFRDYVDRFFKTLRAEQASQEVKNWMTETLLIQNANPDCKSILKALGTGATLEEMMTACQGVGGPSHKA

RVL

SEQ ID NO: 758
HIV M gag CEN-2, Tailored
      MGARASILRGGKLDKWEKIRLRPGGKKHYMLKHIVWASRELEKFALNPDLLETSEGCKQIIKQLQPALQTGT

EELRSLFNTVATLYCVHEKIEVRDTKEALDKVEEEQNKSQQKTQQAKAADGKVSQNYPIVQNAQGQMVHQALSPRTLN

AWVKVIEEKAFSPEVIPMFTALSEGATPSDLNTMLNTIGGHQAAMQMLKDTINEEAAEWDRVHPVHAGPVAPGQMREP

RGSDIAGSTSTLQEQIAWMTSNPPIPVGDIYKRWIILGLNKIVKMYSPVSILDIKQGPKEPFRDYVDRFFKTLRAEQA

TQDVKNWMTDTLLVQNANPDCKTILRALGPGATLEEMMTACQGVGGPSHKARVLAEAMSQANSNIMMQRSNFKGPKRI

VKCFNCGKEGHIAKNCRAPRKKGCWKCGREGHQMKDCNERQANFLGKIWPSNKGRPGNFLQNRPEPTAPPLQSRLEPT

APLEPTAPPEPTAPPAVVPTAPPVEPTAPPAEPTAPPAESFRFEETTPAPKQEPKDREPLTSLKSLFGSDPLSQ

SEQ ID NO: 759
HIV M gag CEN-2 Conserved, Tailored
     PIVQNAQGQMVHQALSPRTLNAWVKVIEEKAFSPEVIPMFTALSEGATPSDLNTMLNTIGGHQAAMQMLKDT

INEEAAEWDRVHPVHAGPVAPGQMREPRGSDIAGSTSTLQEQIAWMTSNPPIPVGDIYKRWIILGLNKIVKMYSPVSI

LDIKQGPKEPFRDYVDRFFKTLRAEQATQDVKNWMTDTLLVQNANPDCKTILRALGPGATLEEMMTACQGVGGPSHKA

RVL

SEQ ID NO: 760
HIV M gag CEN-3, Tailored
       MGSRASVLSGGELDRWEKIRLRPGGKKKYKLKHIVWASRELERFAVNPGLLETSEGCKQILGQLQPALQTGS

EELRSLYNTVAVLYCVHQRIDVKDTKEALEKIEEEQNKCKKKAQQAAAAADTGNNSQVSQNYPIVQNIQGQMVHQALS

PRTLNAWVKVIEEKAFSPEVIPMFTALSEGATPSDLNTMLNTIGGHQAAMQMLKDTINEEAADWDRLHPVQAGPVAPG

QMRDPRGSDIAGTTSNLQEQIGWMTSNPPIPVGDIYKRWIIMGLNKIVRMYSPTSILDIKQGPKEPFRDYVDRFFKTL

RAEQASQEVKNWMTETLLVQNSNPDCKTILKALGPGATLEEMMTACQGVGGPSHKARVLAEAMSQATNSAAIMMQRGN

FRNQRKIVKCFNCGKEGHIAKNCRAPRKRGCWKCGREGHQMKDCNERQANFLGRIWPSNKGRPGNFLQNRPEPTAPNF

LQSRPEPSAPPEPTAPPEESFRFGEETATPSQKQEPTDKELYPLASLRSLFGNDPSSQ

SEQ ID NO: 761
HIV M gag CEN-3 Conserved, Tailored
     PIVQNIQGQMVHQALSPRTLNAWVKVIEEKAFSPEVIPMFTALSEGATPSDLNTMLNTIGGHQAAMQMLKDT

INEEAADWDRLHPVQAGPVAPGQMRDPRGSDIAGTTSNLQEQIGWMTSNPPIPVGDIYKRWIIMGLNKIVRMYSPTSI

LDIKQGPKEPFRDYVDRFFKTLRAEQASQEVKNWMTETLLVQNSNPDCKTILKALGPGATLEEMMTACQGVGGPSHKA

RVL

SEQ ID NO: 762
HIV M gag CEN-4, Tailored
       MGTRASVLSGGELDRWEKIRLRPGGKKKYKLKHIVWASRELERFAVNPGLLETAEGCRQILEQLQPALQTGS

EELRSLYNTVAVLYCVHQRIDVKDTKEALEKIEEEQNKCKKKAQQTAADTGNNSQVSQNYPIVQNMQGQMVHQPISPR

TLNAWVKVIEEKAFSPEVIPMFTALSEGATPHDLNTMLNTIGGHQAAMQMLKDTINEEAAEWDRVHPVHAGPVAPGQM
```

REPKGSDIAGTTSNLQEQIGWMTHNPPIPVGDIYKRWIIMGLNKIVRMYSPTSILDIKQGPKEPFRDYVDRFFKTLRA

EQASQDVKNWMTETLLVQNSNPDCKTILKALGPGATLEEMMSACQGVGGPSHKARILAEAMSQATNSANIMMQRGNFR

NQRKTVKCFNCGKEGHIAKNCRAPRKRGCWKCGREGHQMKDCNERQANFLGKIWPSYKGRPGNFLQNRPEPTAPPEPT

APPEESFGFGEETTTPPQKQEPIDKDLYPLASLRSLFGNDPSSQ

SEQ ID NO: 763
HIV M gag CEN-4 Conserved, Tailored
PIVQNMQGQMVHQPISPRTLNAWVKVIEEKAFSPEVIPMFTALSEGATPHDLNTMLNTIGGHQAAMQMLKDT

INEEAAEWDRVHPVHAGPVAPGQMREPKGSDIAGTTSNLQEQIGWMTHNPPIPVGDIYKRWIIMGLNKIVRMYSPTSI

LDIKQGPKEPFRDYVDRFFKTLRAEQASQDVKNWMTETLLVQNSNPDCKTILKALGPGATLEEMMSACQGVGGPSHKA

RIL

SEQ ID NO: 764
HIV M gag CEN-5, Tailored
MGARASILSGGKLDAWERIRLRPGGKKKYRMKHLVWASRELDRFALNPSLLETAEGCQQIMEQLQPALKTGT

EELRSLFNTVATLYCVHQRIDVKDTKEALDKIEEIQNKSKQTQQAAADTGNSSKVSQNYPIVQNAQGQMIHQSLSPR

TLNAWVKVIEEKAFSPEVIPMFTALSEGATPQDLNMMLNIVGGHQAAMQMLKDTINEEAAEWDRVHPVHAGPIPPGQM

REPRGGDIAGTTSTPQEQIGWMTSNPPIPVGDIYKRWIILGLHKLVRMYSPVSILDIKQGPKEPFRDYVDRFFKTLRA

EQATQEVKGWMTETLLIQNANPDCKSILRALGPGATLEEMMTACQGVGGPSHKARVLAEAMSQVQHTNIMMQRGNFRG

QKRIKCFNCGKEGHLARNCRAPRKRGCWKCGREGHQMKDCNERQANFLGKIWPSSKGRPGNFPQSRPEPTAPQNRLEP

TAPPAEPTAPPAEIFGMGEEITSPPKQEQKDREQAPPLVSLKSLFGNDLLSQ

SEQ ID NO: 765
HIV M gag CEN-5 Conserved, Tailored
PIVQNAQGQMIHQSLSPRTLNAWVKVIEEKAFSPEVIPMFTALSEGATPQDLNMMLNIVGGHQAAMQMLKDT

INEEAAEWDRVHPVHAGPIPPGQMREPRGGDIAGTTSTPQEQIGWMTSNPPIPVGDIYKRWIILGLHKLVRMYSPVSI

LDIKQGPKEPFRDYVDRFFKTLRAEQATQEVKGWMTETLLIQNANPDCKSILRALGPGATLEEMMTACQGVGGPSHKA

RVL

SEQ ID NO: 766
HIV C gag episensus EG-0, Tailored
MGARASILRGGKLDKWEKIRLRPGGKKHYMLKHLVWASRELERFALNPGLLETSEGCKQIMKQLQPALQTGT

EELRSLYNTVATLYCVHEKIEVRDTKEALDKIEEEQNKSQQKTQQAKAADGKVSQNYPIVQNLQGQMVHQAISPRTLN

AWVKVIEEKAFSPEVIPMFTALSEGATPQDLNTMLNTVGGHQAAMQMLKDTINEEAAEWDRLHPVHAGPVAPGQMREP

RGSDIAGTTSTLQEQIAWMTSNPPIPVGDIYKRWIILGLNKIVRMYSPVSILDIKQGPKEPFRDYVDRFFKTLRAEQA

TQDVKNWMTDTLLVQNANPDCKTILRALGPGATLEEMMTACQGVGGPGHKARVLAEAMSQANSNIMMQRSNFKGPKRI

VKCFNCGKEGHIARNCRAPRKKGCWKCGKEGHQMKDCTERQANFLGKIWPSHKGRPGNFLQSRPEPTAPPAEPTAPPA

ESFRFEETTPAPKQEPKDREPLTSLKSLFGSDPLSQ

SEQ ID NO: 767
HIV C gag episensus EG-0 Conserved, Tailored
PIVQNLQGQMVHQAISPRTLNAWVKVIEEKAFSPEVIPMFTALSEGATPQDLNTMLNTVGGHQAAMQMLKDT

INEEAAEWDRLHPVHAGPVAPGQMREPRGSDIAGTTSTLQEQIAWMTSNPPIPVGDIYKRWIILGLNKIVRMYSPVSI

LDIKQGPKEPFRDYVDRFFKTLRAEQATQDVKNWMTDTLLVQNANPDCKTILRALGPGATLEEMMTACQGVGGPGHKA

RVL

SEQ ID NO: 768
HIV C gag CEN-1, Tailored
MGARASILRGEKLDKWEKIKLRPGGKKR

PRGSDIAGTTSNLQEQIAWMTNNPPIPVGEIYKRWIILGLNKIVRMYSPVSILDIRQGPKEPFRDYVDRFFKCLRAEQ

ATQEVKNWMTDTLLIQNANPDCKTILKALGPGASLEEMMTACQGVGGPSHKARVLAEAMSQVNNANIMMQRGNFKGPK

RIIKCFNCGKEGHLARNCRAPRKKGCWKCGQEGHQMKDCSNERQANFLGKLWPSHKGGRPGNFLQNRPEPTAPPVEPT

APPAEPTAPPAESFKFEETTPVPKQELKDREPLISLKSLFGNDPLSQ

SEQ ID NO: 769
HIV C gag CEN-1 Conserved, Tailored
IVQNAQGQMVHQALSPRTLNAWVKVVEEKAFSPEIIPMFTALSEGATPSDLNSMLNTVGGHQAAMQMLKDTI

NDEAAEWDRVHPVHAGPIAPGQMREPRGSDIAGTTSNLQEQIAWMTNNPPIPVGEIYKRWIILGLNKIVRMYSPVSIL

DIRQGPKEPFRDYVDRFFKCLRAEQATQEVKNWMTDTLLIQNANPDCKTILKALGPGASLEEMMTACQGVGGPSHKAR

VL

SEQ ID NO: 770
HIV C gag CEN-2, Tailored
MGARASILRGEKLDKWERIRLRPGGKKHYMIKHLVWASRELEKFALNPGLLETADGCKQIIKQLHPALQTGT

EELKSLYNTVATLYCVHERIEVRDTKEALDRIEEEQNKCQQKTQQAEAADKGKVSQNYPIVQNAQGQMVHQPISPRTL

NAWVKVVEEKAFSPEIIPMFTALSEGATPTDLNTMLNTIGGHQAAMQILKDTINEEAVEWDRLHPVQAGPVAPGQIRE

PRGSDIAGTTSNLQEQIAWMTGNPPVPVGDIYKRWIIMGLNKIVRMYSPVSILDIRQGPKEPFRDYVDRFFKVLRAEQ

ATQEVKNWMTETLLVQNANPDCKIILKGLGPAATLEEMMTACQGVGGPSHKARVLAEAMSQVNNTNIMMQKSNFKGPK

RTVKCFNCGKEGHIAKNCRAPRKKGCWKCGREGHQMKDCNERQANFLGKIWPSQKGRPGNFLQNRPEPTAPRPEPTAP

PRLEPTAPPAEPSAPPAESFRFEGTTPAPKQESKDREPLISLKSLFGNDPLSQ

SEQ ID NO: 771
HIV C gag CEN-2 Conserved, Tailored
PIVQNAQGQMVHQPISPRTLNAWVKVVEEKAFSPEIIPMFTALSEGATPTDLNTMLNTIGGHQAAMQILKDT

INEEAVEWDRLHPVQAGPVAPGQIREPRGSDIAGTTSNLQEQIAWMTGNPPVPVGDIYKRWIIMGLNKIVRMYSPVSI

LDIRQGPKEPFRDYVDRFFKVLRAEQATQEVKNWMTETLLVQNANPDCKIILKGLGPAATLEEMMTACQGVGGPSHKA

RVL

SEQ ID NO: 772
HIV C gag CEN-3, Tailored
MGARASILRGEKLDRWERIRLRPGGKKCYMLKHIVWASRELERFSLNPGLLETAEGCKQIIKQLHPALQTGT

EELKSLFNTVATLYCVHKKIDVRDTKEALDKVEEEQNKCQQKTQQAKAADEKVSQNYPIVQNIQGQMVHQALSPRTLN

AWVKVVEEKAFSPEIIPMFTALSEEATPQDLNTMLNAVGGHQAAMQMLKETINEEAAEWDRVHPVHAGPIAPGQMREP

RGSDIAGTTSNLQEQIAWMTNNPPIPVGEIYKRWIILGLNKIVRMYSPVSILDIRQGPKEPFRDYVDRFFRVLRAEQA

TQEVKNWMTDTLLIQNANPDCKTILKALGPGASLEEMMTACQGVGGPSHKARVLAEAMSQANNINIMMQRGNFKGPKR

TVKCFNCGKEGHIAKNCRAPRKRGCWKCGKEGHQMKDCNERQANFLGRIWPSHKGRPGNFLQNRPEPTAPSAESFRQN

RTEPTAPPARLEPTAPPAEPSAPPVESFRFEETTPALKQESKDREPLTSLRSLFGSDPLFQ

SEQ ID NO: 773
HIV C gag CEN-3 Conserved, Tailored
PIVQNIQGQMVHQALSPRTLNAWVKVVEEKAFSPEIIPMFTALSEEATPQDLNTMLNAVGGHQAAMQMLKET

INEEAAEWDRVHPVHAGPIAPGQMREPRGSDIAGTTSNLQEQIAWMTNNPPIPVGEIYKRWIILGLNKIVRMYSPVSI

LDIRQGPKEPFRDYVDRFFRVLRAEQATQEVKNWMTDTLLIQNANPDCKTILKALGPGASLEEMMTACQGVGGPSHKA

RVL

SEQ ID NO: 774
HIV C gag CEN-4, Tailored
MGARASVLRGEKLDKWERIRLRPGGKKQYMLKHIVWASRELEKFALNPGLLETAEGCKQIIKQLHPALQTGT

EELRSLFNTVATLYCVHKGIDVRDTKEALDKVEEEQNKCQQKTQQAEADKKVSQNYPIVQNIQGQMVHQPLSPRTLNA

WVKVVEEKAFSPEVIPMFSALSEGATPGDLNTMLNTIGGHQAAMQMLKDTINDEAAEWDRLHPVHAGPIAPGQMREPR

GSDIAGTTSNLQEQIAWMTNNPPVPVGEIYKRWIVLGLNKIVRMYSPVSILDIRQGPKEPFRDYVDRFFRTLRAEQAT

SEQ ID NO: 775
HIV C gag CEN-4 Conserved, Tailored
      PIVQNIQGQMVHQPLSPRTLNAWVKVVEEKAFSPEVIPMFSALSEGATPGDLNTMLNTIGGHQAAMQMLKDT

INDEAAEWDRLHPVHAGPIAPGQMREPRGSDIAGTTSNLQEQIAWMTNNPPVPVGEIYKRWIVLGLNKIVRMYSPVSI

LDIRQGPKEPFRDYVDRFFRTLRAEQATQEVKNWMTETLLVQNANPDCKNILRALGPGASLEEMMTACQGVGGPSHKA

RVL

SEQ ID NO: 776
HIV C gag CEN-5, Tailored
      MGARASVLRGEKLDKWERIRLRPGGKKRYMLKHIVWASRELEKFALNPGLLETAEGCKQIIKQLQPALQTGT

EELKSLFNTVATLYCVHEKIDVRDTKEALDRIEEEQNKCQQKTQQAKAADEKVSQNYPIVQNAQGQMVHQALSPRTLN

AWVKVIEEKGFNPEVIPMFTALSDGATPQDLNSMLNTVGGHQAAMQILKDTINEEAAEWDRVHPVHAGPIAPGQMREP

RGSDIAGTTSNLQEQIAWMTGNPPIPVGEIYKRWIILGLNKIVRMYSPVSILDIRQGPKEPFRDYVDRFFKALRAEQA

TQEVKNWMTETLLVQNANPDCKNILRALGPGASLEEMMTACQGVGGPSHKARVLAEAMSQANNTNIMMQRNNFKGPKR

IIKCFNCGKEGHIAKNCRAPRKKGCWKCGREGHQMKDCNERQANFLGRIWPSHKGGRPGNFLQNRPEPTAPPVEPTAP

PAEPTAPPAESFKFEETTPTPKQEQKDREPLISLKSLFGNDPLSQ

SEQ ID NO: 777
HIV C gag CEN-5 Conserved, Tailored
      PIVQNAQGQMVHQALSPRTLNAWVKVIEEKGFNPEVIPMFTALSDGATPQDLNSMLNTVGGHQAAMQILKDT

INEEAAEWDRVHPVHAGPIAPGQMREPRGSDIAGTTSNLQEQIAWMTGNPPIPVGEIYKRWIILGLNKIVRMYSPVSI

LDIRQGPKEPFRDYVDRFFKALRAEQATQEVKNWMTETLLVQNANPDCKNILRALGPGASLEEMMTACQGVGGPSHKA

RVL

SEQ ID NO: 778
HIV B gag episensus EG-0, Tailored
      MGARASVLSGGELDRWEKIRLRPGGKKKYKLKHIVWASRELERFAVNPGLLETSEGCRQILGQLQPSLQTGS

EELKSLYNTVATLYCVHQKIDVKDTKEALDKIEEEQNKSKKKAQQAAADTGNSSQVSQNYPIVQNLQGQMVHQAISPR

TLNAWVKVVEEKAFSPEVIPMFSALSEGATPQDLNTMLNTVGGHQAAMQMLKETINEEAAEWDRLHPVHAGPIAPGQM

REPRGSDIAGTTSTLQEQIGWMTNNPPIPVGEIYKRWIILGLNKIVRMYSPTSILDIRQGPKEPFRDYVDRFYKTLRA

EQASQEVKNWMTETLLVQNANPDCKTILKALGPAATLEEMMTACQGVGGPGHKARVLAEAMSQVTNSATIMMQRGNFR

NQRKTVKCFNCGKEGHIARNCRAPRKKGCWKCGKEGHQMKDCTERQANFLGKIWPSHKGRPGNFLQSRPEPTAPPEPT

APPEESFRFGEETTTPSQKQEPIDKELYPLASLKSLFGNDPSSQ

SEQ ID NO: 779
HIV B gag episensus EG-0 Conserved, Tailored
      PIVQNLQGQMVHQAISPRTLNAWVKVVEEKAFSPEVIPMFSALSEGATPQDLNTMLNTVGGHQAAMQMLKET

INEEAAEWDRLHPVHAGPIAPGQMREPRGSDIAGTTSTLQEQIGWMTNNPPIPVGEIYKRWIILGLNKIVRMYSPTSI

LDIRQGPKEPFRDYVDRFYKTLRAEQASQEVKNWMTETLLVQNANPDCKTILKALGPAATLEEMMTACQGVGGPGHKA

RVL

SEQ ID NO: 780
HIV B gag CEN-1, Tailored
      MGSRASVLSGGKLDQWEKIRLRPGGKKRYKLKHLVWASRELERFAVNPSLLETSEGCKQILGQLQPALQTGS

EELRSLYNTIAVLYCVHQRIEVKDTKEALEKIEEEQNKCKKKAQQAAAAAADTGNSNQVSQNYPIVQNMQGQMVHQAL

SPRTLNAWVKVIEEKAFSPEVIPMFTALSEGATPADLNTMLNTIGGHQAAMQILKETINEEAAEWDRVHPVHAGPVAP

GQMREPRGSDIAGSTSTLQEQIAWMTSNPPIPVGDIYKRWIIMGLNKIVRMYSPTSILDIKQGPKEPFRDYVDRFYKT

LRAEQATQEVKNWMTETLLVQNSNPDCKTILKALGPGATLEEMMTACQGVGGPSHKARVLAEAMSQVTTPPAIMMQRG

NFKNQRKIVKCFNCGKEGHLARNCRAPRKRGCWKCGREGHQMKDCSERQANFLGKIWPSYKGRPGNFLQNRPEPTAPP

AEPTAPPAESFRFGEETATPPQKQEPIDKEMYPLTSLRSLFGNDPSQ

SEQ ID NO: 781
HIV B gag CEN-1 Conserved, Tailored
    PIVQNMQGQMVHQALSPRTLNAWVKVIEEKAFSPEVIPMFTALSEGATPADLNTMLNTIGGHQAAMQILKET

INEEAAEWDRVHPVHAGPVAPGQMREPRGSDIAGSTSTLQEQIAWMTSNPPIPVGDIYKRWIIMGLNKIVRMYSPTSI

LDIKQGPKEPFRDYVDRFYKTLRAEQATQEVKNWMTETLLVQNSNPDCKTILKALGPGATLEEMMTACQGVGGPSHKA

RVL

SEQ ID NO: 782
HIV B gag CEN-2, Tailored
    MGSRASVLSGGKLDKWEKIRLRPGGKKKYRLKHLVWASRELERYALNPGLLETAEGCRQILGQLQPALQTGS

EELKSLFNTVAVLYCVHQRIDVKDTKEALEKIEEEQNKSKKKTQQAAADTGNNSQVKVSQNYPIVQNIQGQMVHQALS

PRTLNAWVKVIEEKAFSPEVIPMFTALSEGATPHDLNTMLNTIGGHQAAMQILKETINDEAAEWDRTHPVHAGPVAPG

QMRDPRGSDIAGTTSNLQEQIGWMTHNPPIPVGDIYKRWIIMGLNKIVRMYSPVSILDIKQGPKEPFRDYVDRFYKIL

RAEQASQDVKNWMTETLLVQNSNPDCKTILKALGPGATLEEMMTACQGVGGPSHKARVLAEAMSQMTNSATIMMQKGN

FRNQRKTIKCFNCGKEGHLARNCRAPRKRGCWKCGQEGHQMKDCNERQANFLGKIWPSSKGRPGNFLQSRPESRPEPT

APPAEPTAPPAESFRFGEETATPPQKQEPIDKEMYPLASLRSLFGNDPSSK

SEQ ID NO: 783
HIV B gag CEN-2 Conserved, Tailored
    PIVQNIQGQMVHQALSPRTLNAWVKVIEEKAFSPEVIPMFTALSEGATPHDLNTMLNTIGGHQAAMQILKET

INDEAAEWDRTHPVHAGPVAPGQMRDPRGSDIAGTTSNLQEQIGWMTHNPPIPVGDIYKRWIIMGLNKIVRMYSPVSI

LDIKQGPKEPFRDYVDRFYKILRAEQASQDVKNWMTETLLVQNSNPDCKTILKALGPGATLEEMMTACQGVGGPSHKA

RVL

SEQ ID NO: 784
HIV B gag CEN-3, Tailored
    MGARASILSGGELDKWEKIRLRPGGKKQYKLKHIVWASRELERFALNPGLLETSGGCRQILEQLQPALQTGS

EELRSLYNTVAVLYCVHQRIEVKDTKEALEKIEEEQNKCKKKAQQAAAAAADTGNNSQVSQNYPIVQNIQGQMVHQAL

SPRTLNAWVKVIEEKAFSPEVIPMFTALSEGATPGDLNLMLNAVGGHQAAMQMLKDTINEEAADWDRLHPVQAGPVAP

GQLREPRGSDIAGTTSNLQEQIAWMTHNPPIPVGEIYKRWIIMGLNKIVRMYSPVSILDIKQGPKEPFRDYVDRFYRT

LRAEQASQDVKNWMTETLLIQNANPDCRTILKALGPGATLEEMMTACQGVGGPSHKARVLAEAMSQATSSATIMMQKG

NFRNQRKIVKCFNCGKEGHIAKNCRAPRKRGCWKCGREGHQMKDCSERQANFLGKIWPSYKGRPGNFLQNRPEPTAPP

AEPTAPPAESFRFGEETTTPPQKQEPTDKELYPLASLRSLFGNDPLSQ

SEQ ID NO: 785
HIV B gag CEN-3 Conserved, Tailored
    PIVQNIQGQMVHQALSPRTLNAWVKVIEEKAFSPEVIPMFTALSEGATPGDLNLMLNAVGGHQAAMQMLKDT

INEEAADWDRLHPVQAGPVAPGQLREPRGSDIAGTTSNLQEQIAWMTHNPPIPVGEIYKRWIIMGLNKIVRMYSPVSI

LDIKQGPKEPFRDYVDRFYRTLRAEQASQDVKNWMTETLLIQNANPDCRTILKALGPGATLEEMMTACQGVGGPSHKA

RVL

SEQ ID NO: 786
HIV B gag CEN-4, Tailored
    MGARASILSGGELDKWEKIRLRPGGKKKYRLKHIVWASNELERFALNPGLLETSDGCRQILGQLHPSLQTGS

EELRSLYNTVAVLYCVHQRIEIKDTKEALEKIEEEQNKCKKKAQQAAAAQQAAAGTGNNSQVSQNYPIVQNMQGQMVH

QALSPRTLNAWVKVIEEKAFSPEVIPMFTALSEGATPHDLNTMLNTIGGHQAAMQILKETINEEAAEWDRVHPVHAGP

IAPGQIREPRGSDIAGTTSNLQEQIGWMTHNPPIPVGEIYKKWIIMGLNKIVRMYSPVSILDIKQGPKEPFRDYVDRF

YKTLRAEQATQEVKNWMTETLLVQNSNPDCKTILKALGPGATLEEMMTACQGVGGPAHKARVLAEAMSQATNSAAIMM

QKGNFRNQRRTVKCFNCGKEGHIAKNCRAPRKKGCWKCGQEGHQMKDCNERQANFLGRSWPSLKGRPGNFLQNRPEPS

APPEESFKFGEETTTPPQKQEPIDKDLYPLASLRSLFGNDPSST

SEQ ID NO: 787
HIV B gag CEN-4 Conserved, Tailored
PIVQNMQGQMVHQALSPRTLNAWVKVIEEKAFSPEVIPMFTALSEGATPHDLNTMLNTIGGHQAAMQILKET

INEEAAEWDRVHPVHAGPIAPGQIREPRGSDIAGTTSNLQEQIGWMTHNPPIPVGEIYKKWIIMGLNKIVRMYSPVSI

LDIKQGPKEPFRDYVDRFYKTLRAEQATQEVKNWMTETLLVQNSNPDCKTILKALGPGATLEEMMTACQGVGGPAHKA

RVL

SEQ ID NO: 788
HIV B gag CEN-5, Tailored
MGSRASVLSGGKLDKWEKIRLRPGGKKKYQLKHIVWASRELERYALNPGLLETAEGCRQILEQLQPALQTGS

EELRSLYNTVAVLYCVHQKIEVKDTKEALEKVEEEQNKSKKRIQQAQQAAAADTGNSSKVSQNYPIVRNLQGQMVHQP

ISPRTLNAWVKVIEEKAFSPEVIPMFSALAEGATPQDLNLMLNAVGGHQAAMQMLKDTINEEAAEWDRMHPVHAGPVA

PGQMREPRGSDIAGTTSNLQEQIGWMTSNPPIPVGEIYKRWIIMGLNKIVRMYSPVSILDIKQGPKEPFRDYVDRFYR

TLRAEQASQDVKNWMTETLLVQNSNPDCKTILKALGPGATLEEMMTACQGVGGPSHKARVLAEAMSQVTNSTAIMMQR

GNFKNQRKIVKCFNCGKEGHIAKNCRAPRKRGCWKCGREGHQMKECTERQVNFLGKIWPSYKGRPGNFLQNRPEPTAP

PAPPEESFRFGEGTTTPSQKQGTIDKELYPLTSLRSLFGNDPS

SEQ ID NO: 789
HIV B gag CEN-5 Conserved, Tailored
PIVRNLQGQMVHQPISPRTLNAWVKVIEEKAFSPEVIPMFSALAEGATPQDLNLMLNAVGGHQAAMQMLKDT

INEEAAEWDRMHPVHAGPVAPGQMREPRGSDIAGTTSNLQEQIGWMTSNPPIPVGEIYKRWIIMGLNKIVRMYSPVSI

LDIKQGPKEPFRDYVDRFYRTLRAEQASQDVKNWMTETLLVQNSNPDCKTILKALGPGATLEEMMTACQGVGGPSHKA

RVL

SEQ ID NO: 790
VTSSNMNNA

SEQ ID NO: 791
TSSNMNNAD

SEQ ID NO: 792
TSSNMNNADSVWLRAQEEE

SEQ ID NO: 793
TSSNMNNADCVWLRAQEEE

SEQ ID NO: 794
ARCHSLM

SEQ ID NO: 795
DEFGKLM

SEQ ID NO: 796
EPTAPPAEPTAP

SEQ ID NO: 797
PTAPPAEPTAPP

SEQ ID NO: 798
EPTAPPAEPTAPP

SEQ ID NO: 799
ARCGSLM

SEQ ID NO: 800
ARCGSPM

SEQ ID NO: 801
ARYGSLM

SEQ ID NO: 802
AYCHSLM

```
SEQ ID NO: 803
YRCHSLM

SEQ ID NO: 804
DEFGSLM

SEQ ID NO: 805
DEFGKLM

SEQ ID NO: 806
ARCCDEGH

SEQ ID NO: 807
ARCDEFGH

SEQ ID NO: 808
ARCCDE-GH

SEQ ID NO: 809
ARC-DEFGH

SEQ ID NO: 810
DECHJLM

SEQ ID NO: 811
DEFGJLM
```

SEQUENCE LISTING (810 sequences)

SEQ ID NO: 1 - protein, 500 aa, Human immunodeficiency virus
MGARASVLSGGELDRWEKIRLRPGGKKKYKLKHIVWASRELERFAVNPGLLETSEGCRQILGQLQPSLQTGSEELRSLYNTVATLYCVHQRIEIKDTKEALDKIEEEQNKSKKKAQQAAADTGHSNQVSQNYPIVQNIQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKIVKCFNCGKEGHTARNCRAPRKKGCWKCGKEGHQMKDCTERQANFLGKIWPSYKGRPGNFLQSRPEPTAPPEESFRSGVETTTPPQKQEPIDKELYPLTSLRSLFGNDPSSQ

SEQ ID NO: 2 - protein, 503 aa, Human immunodeficiency virus
  variant (7)..(7): Xaa can be any naturally occurring amino acid
  variant (96)..(96): Xaa can be any naturally occurring amino acid
  variant (372)..(372): Xaa can be any naturally occurring amino acid
  variant (377)..(377): Xaa can be any naturally occurring amino acid
  variant (408)..(408): Xaa can be any naturally occurring amino acid
MGARASXLSGGELDKWEKIRLRPGGKKKYRLKHLVWASRELERFAVNPGLLETAEGCRKIIAQLQPSLQTGSEELKSLFNTVATIYCVHQRIEVKXTKEALEKVEEEQNKSKKKAQQAEAGTGNNSQVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPVPVGEIYKRWIILGLNKIVRMYSPVSILDIKQGPKEPFRDYVDRFYKTLRAEQASQEVKHWMTETLLVQNANPDCKTILKALGPAATLEEMMTACQGVGGPGHKARVLAEAMSQINXATVMXQKGDYRNQRRTVKCFNCGKEGHIAKNCRAPXKKGCWKCGREGHQMKDCTERQANFLGKIWPSHKGRPGNFLQSRPEPTAPPAPPEEIFRFGEETAPSQKQERTDRDKELYPSAALRSLFGNDPLSQ

SEQ ID NO: 3 - protein, 500 aa, Human immunodeficiency virus
  variant (37)..(37): Xaa can be any naturally occurring amino acid
  variant (100)..(100): Xaa can be any naturally occurring amino acid
  variant (104)..(104): Xaa can be any naturally occurring amino acid
  variant (123)..(123): Xaa can be any naturally occurring amino acid
  variant (158)..(158): Xaa can be any naturally occurring amino acid
  variant (164)..(164): Xaa can be any naturally occurring amino acid
  variant (247)..(247): Xaa can be any naturally occurring amino acid
  variant (268)..(268): Xaa can be any naturally occurring amino acid
  variant (290)..(290): Xaa can be any naturally occurring amino acid
  variant (298)..(298): Xaa can be any naturally occurring amino acid
  variant (398)..(398): Xaa can be any naturally occurring amino acid
  variant (427)..(427): Xaa can be any naturally occurring amino acid
MGARASILSGGKLDQWEKIRLRPGGKKKYRLKHLVWXSRELERFAVNPGLLETTEGCKQILEQLQPSLQTGSEELRSLYNTIATLYCVHKNIDVADTKEXLEKXEEEQNKSKKKAQQAAADTXNNSQVSHNYPIVQNLQGQMVHQAISPRTLNAWVKXVEEKAXSPEVIPMFSALSEGATPQDLNTMLNTVGGHQAAMQMLKETINDEAAEWDRLHPPQAGPIAPGQIREPRGSDIAGTTSTLQEQXTWMTNNPPIPVGEIYKRWIIXGLNKIVRMYSPSSILDIRQGPXEPFRDYVXRFYKTLRAEQASQDVKNWMTETLLVQNANPDCKTILKALGPGATLEEMMTACQGVGGPSHKARILAEAMSQVTNSATIMMQRGNFRNQRKIVKCFNCGKXGHIARNCKAPRKKGCWKCGKEGHQMKDCXERQANFLGKIWPSYKGRPGNFLQSRPEPTAPPAESFRFGEETTTPPQKQEQTDKETYPLASLRSLFGNDPSSQ

SEQ ID NO: 4 - protein, 502 aa, Human immunodeficiency virus
MGARASILSGGELDRWEKIRLRPGGKKKYKLKHLVWASRELERFAVNPGLLETSEGCRQILAQLQPALQTGPEELKSVYNTVATLYCVHQRIDVKDTREALDKIEEEQNKSKKKAQQAAADTGNSRNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIIMGLNKIVRMYSPTSILDVRQGPKEPFRDYVDRFYKTLRAEQASQDVKNWMTETLLVQNANPDCKTILKALGPAATLEEMMTACQGVGGPSHKARVLAEAMSQANSTTIMMQKGNFRNQRKTVKCFNCGKEGHIARNCRAPRKKGCWKCGREGHQMKDCTERQANFLGKIWPSHEGRPGNFLQSRPEPTAPPEESFRFGEGTTTPSQKQEPIDKELYPLTSLKSLFGNDPSSQ

SEQ ID NO: 5 - protein, 499 aa, Human immunodeficiency virus
  variant (64)..(64): Xaa can be any naturally occurring amino acid
  variant (114)..(114): Xaa can be any naturally occurring amino acid
  variant (124)..(124): Xaa can be any naturally occurring amino acid
  variant (167)..(167): Xaa can be any naturally occurring amino acid
  variant (175)..(175): Xaa can be any naturally occurring amino acid
  variant (255)..(255): Xaa can be any naturally occurring amino acid
  variant (351)..(351): Xaa can be any naturally occurring amino acid
  variant (388)..(388): Xaa can be any naturally occurring amino acid
  variant (391)..(391): Xaa can be any naturally occurring amino acid
  variant (436)..(436): Xaa can be any naturally occurring amino acid
MGARASILSGGKLDRWEKIRLRPGGKKQYKLKHLVWASRELERFAVNPGLLETSDGCRRILGQXQPSLQTGSEELKSLYNTVATLYCVHQGIDIKDTKEALDKIEEEQNKCKKXAQQAAADTGXSSQVSQNYPIVQNLQGQMVHQAISPRTLNAWVKVIEEKAFSPXVIPMFSAXSEGATPQDLNTMLNTVGGHQAAMQMLKDTINEEAAEWDRLHPVHAGPVAPGQMREPRGSDIAGTTSTLQEQIGWMTNNPXIPVGEIYKRWIILGLNKIVRMYSPVSILDIRQGPKEPFRDYVDRFYKTLRAEQASQDVKNWMTETLLIQNANPDCKTILKALGPAATLEEMMTACXGVGGPGHKARVLAEAMCQANSNTIMMQRGNFKSQRKXVKXFNCGREGHIAKNCRAPRKKGCWKCGKEGHQMKDCTERQVNFLGKXWPSNKGRPGNFLQSRPEPTAPPAESFRFGEETTAPPQKQEPIDKDLYPLASLKSLFGSDPSSQ

SEQ ID NO: 6 - protein, 502 aa, Human immunodeficiency virus
  variant (43)..(43): Xaa can be any naturally occurring amino acid
  variant (67)..(67): Xaa can be any naturally occurring amino acid
  variant (174)..(174): Xaa can be any naturally occurring amino acid
  variant (238)..(238): Xaa can be any naturally occurring amino acid
  variant (324)..(324): Xaa can be any naturally occurring amino acid
  variant (335)..(335): Xaa can be any naturally occurring amino acid
  variant (340)..(340): Xaa can be any naturally occurring amino acid
  variant (395)..(395): Xaa can be any naturally occurring amino acid
  variant (424)..(424): Xaa can be any naturally occurring amino acid
  variant (489)..(489): Xaa can be any naturally occurring amino acid
MGARASILSGGQLDRWEKIRLRPGGKKKYQLKHLVWASRELEXFAVNPGLLETSEGCRQILGQLHPXLHTGSEELKSVYNTVATLYCVHQRIDIKDTKEALEKIEEEQNKIKKKVQQAAADTGNSSQVSQNYPIVQNIQGQMVHQPISPRTLNAWVKVVEEKAFSPEVIPMFAXLSEGATPQDLNTMLNTVGGHQAAMQMLKETINEEAAEWDRLHPVPAGPIAPGQMRDPRGSDIAXTTSTLQEQIGWMTSNPPIPVGEIYKKWIIMGLNKIVRMYSPTSILDIRQGPKEPFRDYVDRFYKTLRAEQASQEVKNWMTETLLVXNANPDCKTILXALGPXATLEEMMTACQGVGGPGHKARVLAEAMSQATNAGAIMMQKGNFRNQRKSIKCFNXGKEGHLARNCKAPRKKGCWKCGKEGHQMXDCNERQVNFLGKIWPSHKGRPGNFLQSRPEPTAPPEESFRFGEETTTPSQKQETIDRDKELYPLXSLRSLFGNDPSSQ

SEQ ID NO: 7 - protein, 500 aa, Human immunodeficiency virus
  variant (61)..(61): Xaa can be any naturally occurring amino acid
  variant (191)..(191): Xaa can be any naturally occurring amino acid
  variant (197)..(197): Xaa can be any naturally occurring amino acid
  variant (216)..(216): Xaa can be any naturally occurring amino acid
  variant (223)..(223): Xaa can be any naturally occurring amino acid
  variant (246)..(246): Xaa can be any naturally occurring amino acid
  variant (295)..(295): Xaa can be any naturally occurring amino acid
MGARASVLSGGELDKWEKIRLRPGGKKKYRLKHIVWASRELERFAVNPGLLETSGGCRQIXEQIQPSLKTGSEELRSLFNTVAVLYCVHQRIDVKDTKEALDKIEEEQNKSKKKAQPAAADTGNNSQVSQNYPIVQNIQGQMVHQPISPRTLNAWVKVIEERAFSPEVIPMFSALSEGATPSDLNIMLNTXGGHQAXMQMLKETINEEAAEWDRLXPVHAGPXAPGQMREPRGSDIAGTTSTLQEXIGWMTGNPAIPVGDIYKRWIILGLNKIVRMYSPTSILDIRQGPKEPFRXYVDRFYKTLRAEQASQDVKNWMTETLLVQNANPDCKTILKALGPAATLEEMMTACQGVGGPSHKARVLAEAMSQATASTNIMMQRGNFRNQRKTVKCFNCGKEGHIAKNCRAPRKKGCWKCGKEGHQMKDCTERQANFLGKIWPSHKGRPGNFLQSRPEPTAPPAESFGFGEETTTPPQKQEPIDKELYPLASLKSLFGSDPASQ

SEQ ID NO: 8 - protein, 507 aa, Human immunodeficiency virus
  variant (118)..(118): Xaa can be any naturally occurring amino acid
  variant (127)..(127): Xaa can be any naturally occurring amino acid
  variant (140)..(140): Xaa can be any naturally occurring amino acid
  variant (149)..(149): Xaa can be any naturally occurring amino acid
  variant (195)..(195): Xaa can be any naturally occurring amino acid
  variant (298)..(298): Xaa can be any naturally occurring amino acid
  variant (372)..(372): Xaa can be any naturally occurring amino acid
  variant (465)..(465): Xaa can be any naturally occurring amino acid
  variant (472)..(472): Xaa can be any naturally occurring amino acid
MGARASVLSGGELDRWEKIRLRPGGKKKYKLKHIVWASRELERFAVNPGLLETSEGCRQILGQLQPSLQTGSEELKSLYNTVATLYCVHQRIEIKDTKEALDKIEEEQNKSKKKAQQXAADTGSSSXVSPVSQNYPIVQXMQGQMVHQXISPRTLNAWVKVIEEKAFSPEVIPMFSALSEGATPQDLNTMLNTVXGHQAAMQMLKETINEEAAEWDRVHPVHAGPIAPGQMREPRGSDIAGTTSTLQEQIGWMTNNPPIPVGEIYKRWIILGLNKIVRMYSPVSILDIRQGPKEPFRXYVDRFYKTLRAEQATQEVKNWMTETLLVQNANPDCKTILKALGPAATLEEMMTACQGVGGPGHKARVLAEAMSXVTNSANIMMQRGNFRNQRKTVKCFNCGKEGHIARNCRAPRKKGCWKCGKEGHQMKDCTERQVNFLGKIWPSHKGRPGNFFQSRLESRPEPTAXPEESFRXGEETTTPPQKQEPIDKELYPLASLRSLFGNDPSSQ

SEQ ID NO: 9 - protein, 502 aa, Human immunodeficiency virus
  variant (485)..(485): Xaa can be any naturally occurring amino acid
MGARASVLSGGELDRWEKIRLRPGGKKKYRLKHVVWASRELERFALNPGLLETSEGCRQIMEQIQPALQTGSEELRSLYNTVAVLYCVHHKIDVKDTKEALDKIEEEQNKSKKKAQQAAAAADTGNSGKVSQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQATNATTIMMQRGNFRNQRRTVKCFNCGKEGHIAKNCRAPRKKGCWKCGKEGHQMKDCTERQVNFLGKIWPSHKGRPGNFLQSRPEPTAPPAESFRFGEETTTPPQKQEPTDKDXYPLASLRSLFGNDPSSQ

SEQ ID NO: 10 - protein, 502 aa, Human immunodeficiency virus
  variant (163)..(163): Xaa can be any naturally occurring amino acid
MGARASVLSGGKLDRWEKIRLRPGGKKKYKLKHIVWASRELERFAVNPGLLETSGGCRQILEQLQPALRTGSEELKSLYNTVATLYCVHQQIDVKDTKEALDRIEAEQNESKKKTQQAAADPGNSSQVSQNYPIVQNIQGQMVHQAISPRTLNAWVKVVEEKXFSPEVIPMFSALSEGATPQDLNTMLNTVGGHQAAMQMLKETINEEAAEWDRTHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNNKKTVKCFNCGKEGHIARNCRAPRKKGCWKCGKEGHQMKDCTERQVNFLGKIWPSHKGRPGNFLQSRLEPSRPEPTAPPEESFRFGEETPTPPQKQEPIDKELYPSASLRSLFGNDP

SEQ ID NO: 11 - protein, 507 aa, Human immunodeficiency virus
  variant (8)..(8): Xaa can be any naturally occurring amino acid
MGARASVXSGGELDRWEKIRLRPGGKKRYKLKHIVWASRELERFAVNPGLLETSEGCRQILAQLQPSLQTGSEELKSLYNTVATLYCVHQRIDIKDTKEALDKIEEEQNKSKKKAQQAAADTGNSSQVSQNYPIVQNLQGQMVHQSLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPASILDIRQGPKEPFRDYVDRFYKTLRAEQASQEVKNWMTETLLVQNANPDCKTILKALGPGATLEDMMTACQGVGGPGHKARVLAEAMSQVTNSANVMMQRGNFRNQRKPIKCFNCGKEGHIAKNCRAPRKKGCWKCGKEGHQMKDCTERQANFLGRVWPSHKGRPGNFLQSRLEPTAPPEPTAPPEESFRFGGETTTPSQRQEPIDKELYPPLASLKSLFGNDPSSQ

SEQ ID NO: 12 - protein, 502 aa, Human immunodeficiency virus
MGARASILTGGQLDKWEKIRLRPGGKKKYQLKHIVWASRELERFAVNPGLLETAGGCRQILKQLQPSLQTGSEELKSLYNTVAVLYCVHQQIEIKDTKEALDKIEEEQNKSKKQTQQAAAAAGTGNSSQVSQNYPIVQNLQGQMVHQAIAPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIAWMTNNPPIPVGDIYKKWIIIGLNKIVRMYSPASILDIKQGPKEPFRDYVDRFYKTLRAEQASQEVKNWMTETLLVQNANPDCKTILKALGPAATLEEMMTACQGVGGPGHKASVLAEAMSQVTNSATIMIQKGNFRNQRKTIKCFNCGKEGHIARNCRAPRKRGCWKCGKEGHQMKECTERQANFLGKIWPSHKGRPGNFLQSRPEPSAPPAESFRFGEETATPSQKQEQTDKELYPLASLRSLFGNDPSSQ

SEQ ID NO: 13 - protein, 499 aa, Human immunodeficiency virus
MGARASVLSGGELDKWEKIRLRPGGKKKYKLKHIVWASRELERFAVNPGLLETSEGCRQILGQLHPSLPTGSEELRSLYNTVATLYCVHQKIDVKDTKEAVEKVEEEQNKSKKKAQQAAADTGNNSQVSQNYPIVQNLQGQMVHQAISPRTLNAWVKVIEEKAFSPEVIPMFTALSEGATPQDLNTMLNTVGGHQAAMQMLKETINEEAAEWDRLHPVQAGPVAPGQLREPRGSDIAGTTSTLQEQIAWMTHNPPVPVGEIYKRWIILGLNKIVRMYSPVSILDIRQGPKEPFRDYVDRFYKTLRAEQASQEVKNWMTETLLVQNANPDCKNILKALGPAATLEEMMTACQGVGGPGHKARVLAEAMSQVNSTTIMMQRGNFRNQRKTIKCFNCGKEGHLARNCRAPRKKGCWKCGKEGHQMKDCTERQANFLGKIWPSYKGRPGNFLQSRPEPTAPPAESFGFGEEIVTPSQKQEPKDKDLSPLASLRSLFGNDPSSQ

SEQ ID NO: 14 - protein, 500 aa, Human immunodeficiency virus
MGARASVLSGGELDKWEKIRLRPGGKKQYKLKHIVWASRELERFALNPGLLETSEGCRQILGQLQPSLQTGSEELRSLYNTVATLYCVHQRIDVKDTKEALEKIEEEQNKSKKKAQQAAANTGNNSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVTSSNTIMMQRGNFRNQRKSVKCFNCGKEGHIARNCKAPRKKGCWKCGREGHQMKDCTERQANFLGKIWPSHKGRPGNFLQSRPEPTAPPEESFRFGEETTTPSQKQEPRDKELYPLASLRSLFGNDPSSQ

SEQ ID NO: 15 - protein, 498 aa, Human immunodeficiency virus
MGARASVLSGGELDRWEKIRLRPGGKKKYKLKHIVWASRELERFAVNPSLLETSEGCRQILGQLQPALQTGSEEIKSLYNTVATLYCVHQRIEIKDTKEALDKIEEEQNKSKKKAQQSAADTGNSSQVSQNYPIVQNSQGQMIHQAISPRTLNAWVKVVEEKAFSPEVIPMFSALSEGATPHDLNTMLNTVGGHQAAMQMLKETINEEAAEWDRLHPVQAGPIAPGQIREPRGSDIAGTTSTLQEQIAWMTNNPPIPVGEIYKRWIILGLNKIVRMYSPSSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNLRNQRKSVKCFNCGKEGHIARNCRAPRKKGCWKCGKEGHQMKDCTERQANFLGKIWPSHKGRPGNFLQNRTEPTAPPEESFRFGEETTTPSQKQTDKELYPLASLRSLFGNDPSSQ

SEQ ID NO: 16 - protein, 500 aa, Human immunodeficiency virus
MGARASVLSGGELDKWERIRLRPGGKKKYRLKHVVWASRELERFAVNPGLLETTEGCRQILGQLQPALQTGSEELRSLYNTIAVLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQQKEQIDKELYPLASLKSLFGNDPSSQ

SEQ ID NO: 17 - protein, 503 aa, Human immunodeficiency virus
MGARASVLSGGELDRWEKIRLRPGGKKKYQLKHIVWASRELERFAVNPGLLETSEGCRQILGQLQPSLQTGSEELKSLFNTVATLYCVHQKIDVKDTKEALDRIEEEQNKSKIKAQQAAADTGSSSQVSQNYPIVQNLQGQMVHQAISPRTLNAWVKVVEEKAFSPEVIPMFSALAEGATPQDLNTMLNTVGGHQAAMQMLKETINEEAAEWDRLHPIHAGPIAPGQMREPRGSDIAGTTSTLQEQIGWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQATNSTAIMMQRGNFRTQRKPVKCFNCGKEGHIARNCRAPRKKGCWKCGKEGHQMKDCTERQANFLGKIWPSHKGRPGNFLQSRPEPTAPTAPPEESFRFGEETTTPPQKQETIDKEKYPLASLRSLFGNDPLSQ

SEQ ID NO: 18 - protein, 502 aa, Human immunodeficiency virus
MGARASVLSGGELDRWEKIRLRPGGKKKYKLKHIVWASRELERFAVNPGLLETAEGCRKIIGQLQPSLQTGSEELRSLFNTVATLYCVHQKIDVKDTKEALDKIEEEQNKSKKKAQPAAAAAADTGNSSQVSQNYPIVQNLQGQMVHQPLSPRTLNAWVKVVEEKAFSPEVIPMFSALSEGATPQDINTMLNTVGGHQAAMQMLKETINEEAAEWDRLHPVHAGPAAPGQIREPRGSDIAGTTSTLQEQIAWMTHNPPIPVGEIYKKWIIIGLNKIVRMYSPTSILDIKQGPKEPFRDYVDRFYKTLRAEQASQDVKNWMTETLLVQNSNPDCKTILKALGPGATLEEMMTACQGVGGPGHKARVLAEAMSQANSATIMMQKGNFRSQRKTVKCFNCGKEGHIAKNCRAPRKKGCWKCGREGHQMKDCTERQANFLGKIWPSHKGRPGNFLQSRPEPSAPPEESFSFGEGTTAPSQKQEPTDKEMYPLASLRSLFGNDPSSQ

SEQ ID NO: 19 - protein, 502 aa, Human immunodeficiency virus
MGARASVLSGGELDRWEKIRLRPGGKKQYKLKHIVWASRELERFAVNPGLLETSEGCKQILLQLQPALQTGSEELKSLYNTVAVLYCVHQRIDVKDTKEALDRIEEEQNKSKKRAQQAAADTGNNSQNQVSQNYPIVQNFQGQMVHQALSPRTLNAWVKVVEEKAFSPEVIPMFSALAEGATPQDLNTMLNTVGGHQAAMQMLKETINEEAAEWDRLHPVQAGPVAPGQMREPRGSDIAGTTSTLQEQIDWMTHNPPIPVGEIYKRWIIMGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVNSGAIMMQRGNFRNQRKTIKCFNCGKEGHLARNCRAPRKKGCWKCGKEGHQMKECTEKQVNFLGKIWPSHKGRPGNFLQNRPEPTAPPAPPEESFRFGEETTTPPQKQEPIDKYPLASLRSLFGNDPLSQ

SEQ ID NO: 20 - protein, 503 aa, Human immunodeficiency virus
  variant (112)..(112): Xaa can be any naturally occurring amino acid
  variant (118)..(118): Xaa can be any naturally occurring amino acid
MGARASVLSGGQLDKWERIRLRPGGKKKYRLKHIVWASRELERFAVNPGLLESSNGCRQILEQLQPSLKTGSEELRSLYNTVATLYCVHQKIEVRDTKEALEKIEEEQNKSXKKAQQXAAAAADTGSSNQTSQNYPIVQNLQGQMVHQPISPRTLNAWVKVVEEKAFSPEVIPMFTALSEGATPQDLNTMLNTVGGHQAAMQMLKETINEEAAEWDRLHPVHAGPVAPGQMREPRGSDIAGTTSTLQEQIGWMTGNPPIPVGEIYKRWIVMGLNKIVRMYSPTSILDIRQGPKEPFRDYVDRFYKTLRAEQATQEVKNWMTETLLVQNANPDCKTILKALGPGATLEEMMSACQGVGGPGHKARVLAEAMSQVTNSATVMMQRGNFRNQRKTVKCFNCGKEGHIARNCRAPRKKGCWKCGQEGHQMKDCTERQANFLGKIWPSHKGRPGNFLQSRPEPTAPPEESFRFGEETTTPSQKQEPRDKELYPLASLRSLFGNDPSSQ

SEQ ID NO: 21 - protein, 504 aa, Human immunodeficiency virus
MGARASVLSGGKLDQWEKIRLRPGGKKKYRLKHIVWASRELERFAINPGLLETAEGCRQILGQIQPSLQTGSEELRSLYNTVATLYCVHQRMDVKDTKEALDKIEEEQNKSKQKAQRAQQAAADTGNNSNQVSQNYPIVQNMQGQMVHQAISPRTLNAWVKVVEEKAFSPEVIPMFTALSEGATPQDLNTMLNTVGGHQAAMQMLKETINEEAAEWDRLHPVQAGPVAPGQMRDPRGSDIAGTTSTLQEQIGWMTSNPPIPVGEIYKRWIILGLNKIVRMYSPTSILDIKQGPKEPFRDYVDRFYKTLRAEQASQEVKNWMTETLLVQNANPDCKTLLKALGPGATLEEMMTACQGVGGPGHKARVLAEAMSQMTNSATVMMQRGNFRNQRKTVKCFNCGKEGHIARNCRAPRKKGCWKCGREGHQMKDCTERQANFLGKIWPSHKGRPGNFLQSRPEPTAPPAESFGFGEGTTAPSQKQDPIDKELYPLASLKSLFGNDPSSQ

SEQ ID NO: 22 - protein, 500 aa, Human immunodeficiency virus
MGARASVLSGGKLDQWEKIRLRPGGKKQYHLKHIVWASRELERFAVNPGLLETSEGCRQILGQLQPALQTGSEELKSLYNTVAVLYCVHQRIDVKDTKEALEKIEEEQTQSKKKAQQAAADTENNKQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQMSTSPAIMMQRGNFKNQRKTIKCFNCGKEGHIARNCRAPRKKGCWKCGKEGHQMKDCTERQANFLGKIWPAHKGRPGNFLQSRPEPTAPPEESFRFGEETTTPSQKQEPTDKELYPLASLKSLFGNDPSSQ

SEQ ID NO: 23 - protein, 500 aa, Human immunodeficiency virus
MGARASVLSGGELDRWEKIRLRPGGKKKYRLKHVVWASRELERFAVNPGLLETSEGCRQILGQLQPSLQTGSEELKSLYNTVAVLYCVHQKIGVQDTKEALEKIEEEQNKSKKKAQQAVADTGNSSQVSQNYPIVQNIQGQMVHQPISPRTLNAWVKVVEEKAFSPEVIPMFSALSEGATPQDLNTMLNTVGGHQAAMQMLKDTINEEAAEWDRLHPVQAGPVAPGQMREPRGSDIAGTTSTLQEQIGWMTHNPPIPVGDIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARILAEAMSQVTNSTAIMMQKGNFRNQRKPVKCFNCGKEGHISKNCRAPRKKGCWKCGKEGHQMKDCTERQANFLGKIWPSSKGRPGNFLQNRPEPTAPPEESFRFGEETTTPSQKQEPIDKELYPLTSLRSLFGNDPSSQ

SEQ ID NO: 24 - protein, 500 aa, Human immunodeficiency virus
MGARASVLSGGELDKWEKIRLRPGGKKKYKLKHIVWASRELERFAVNPGLLETSGGCRQILGQLQPSLQTGSEELKSLYNTVAVLYCVHQRIEVKDTKEALDKIEEEQNKSKKKAQQAVADTGNSSQVSQNYPIVQNLQGQMVHQAISPRTLNAWVKVIEEKAFSPEVIPMFTALSEGATPQDLNTMLNTVGGHQAAMQMLKETINEEAAEWDRVHPVHAGPVAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLVQNANPDCRTILKALGPAATLEEMMTACQGVGGPSHKARVLAEAMSQATNSSTVLMQKGNFRNQRKIIKCFNCGKEGHLARNCRAPRKKGCWKCGREGHQMKDCTERQANFLGKIWPSHKGRPGNFLQNRPEPSAPPEESFRFGEETATPSQKQEPIDKELYPLTSLKSLFGNDPLSQ

SEQ ID NO: 25 - protein, 503 aa, Human immunodeficiency virus
MGARASILSGGGLDRWEKIRLRPGGKKKYRLKHLVWASRELERFAVNPGLLETSEGCRQILGQLQPSLQTGSEELRSLFNTIAVLYCVHQRIDIKDTKEALEKIEEEQNKSKKKAQQAAADTGNSNPVSQNFPIVQNLQGQMVHQAISPRTLNAWVKVVEEKAFSPEVIPMFTALSEGATPQDLNTMLNTVGGHQAAMQMLKETINEEAAEWDRLHPPQAGPIAPGQMREPRGSDIAGTTSNLQEQIAWMTSNPAVPVGEIYKRWIILGLNKIVRMYSPTSILDIKQGPKEPFRDYVDRFYRTLRAEQASQDVKNWMTETLLVQNANPDCKTILRALGPAATLEEMMTACQGVGGPGHKAKILAEAMSQATASAAIMMQRGNYRNQRKPVKCFNCGKEGHIAKNCRAPRKKGCWKCGREGHQMKDCNERQANFLGKIWPSHKGRPGNFLQNRPEPTAPPAPPEESFRFGEETTTPPQKQETIDKELYPLTSLKSLFGNDPSSQ

SEQ ID NO: 26 - protein, 500 aa, Human immunodeficiency virus
MGARASVLSGGELDRWEKIRLRPGGKKKYKLKHIVWASRELERFAVNPGLLETSGGCRQILGQLQPSLQTGSEELKSLYNTVATLYCVHQKIDVKDTKEALEKIEEEQNKSKKKAQQAAADAEKSQASQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPTSILDIKQGPKEPFRDYVDRFYKVLRAEQASQEVKNWMTETLLVQNANPDCKTILKALGPAATLEEMMTACQGVGGPGHKARVLAEAMSQVTNSATVMMQRGNPRNQRRPVKCFNCGKEGHIAKNCRAPRRRGCWKCGKEGHQMKDCTERQANFLGKIWPSHKGRPGNFLQSRPEPTAPPPPESFGFGEETAAPSQKQEPIDKELYPLASLKSLFGNDPSSQ

SEQ ID NO: 27 - protein, 500 aa, Human immunodeficiency virus
MGARASVLSGGKLDRWEKIRLRPGGKKKYKLKHIVWASREVERFAVNPGLLETSEGCRQILGQLQPSLQTGSEELKSLFNAVAVLYCVHQGMEIKDTKEALDKIEEEQNKSKKKAQQAEAGTGNSSQISQNYPIVQNLQGQMVHQAISPRTLNAWVKVIEEKAFSPEVIPMFSALSEGATPQDLNTMLNTVGGHQAAMQMLKETINEEAAEWDRLHPVHAGPNAPGQMREPRGSDIAGSTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSQATGPAAIMMQKGNFRPQRKTIKCFNCGKEGHLAKNCRAPRKKGCWKCGKEGHQMKDCTERQVNFLGKIWPSHKGRPGNFLQSRLEPTAPPEESFRFGEETTTPSQKQEPRDQELYPLASLKSLFGNDPSSQ

SEQ ID NO: 28 - protein, 498 aa, Human immunodeficiency virus
MGARASVLSGGKLDKWEKIRLRPGGKKKYKLKHIVWASRELERFAVNPGLLETSEGCRQILMQLQPSLQTGSEELKSLYNTVATLYCVHQNVEIRDTKEALDKIEEERNKSKKKAQQAAADTGTNSQVSQNYPIVQNLQGQMVHQPISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYRTLRAEQASQDVKNWMTETLLVQNANPDCKTILKALGPAATLEEMMTACQGVGGPGHKARVLAEAMSQVTNSATIMMQRGNFRNQRKIVKCFNCGKEGHIAKNCRAPRKRGCWKCGKEGHQMKDCTERQANFLGKIWSSQKGRPGNFLQSRPEPTAPPEERFREETTTPSQKQEPIDKELYPLASLRSLFGNDPSLQ

SEQ ID NO: 29 - protein, 498 aa, Human immunodeficiency virus
MGARASVLSGGELDKWERIRLRPGGKKKYKLKHIVWASRELERFALNPGLLETSEGCRQIIGQLQPSLKTGSEEIKSLYNTVATLYCVHQRIEVKDTKEALDKIEEEQNKSKKKAQQAAADTGNSSSKVSQNYPIVQNLQGQMVHQPLSPRTLNAWVKVVEEKNFSPEVIPMFTALSEGATPQDLNTMLNTIGGHQAAMQMLKETINEEAAEWDRLHPVHAGPIAPGQMREPRGSDIAGTTSNLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPGASLEEMMTACQGVGGPGHKARVLAEAMSQVTTPPAIMMQKGNFRNQRKIVKCFNCGKEGHIAKNCRAPRKRGCWKCGKEGHQMKDCTERQANFLGKIWPSHKGRPGNFLQSRPEPSAPPAESFGFGEETTTPPQKQESRDKELYPLASLKSLFGNDP

SEQ ID NO: 30 - protein, 500 aa, Human immunodeficiency virus
MGARASVLSGGELDRWEKIRLRPGGKKKYRLKHIVWASRELERFAVNPGLLETAGGCKQIMEQLQPSLQTGSEELRSLFNTIAVLYCVHQRIEVKDTKEALEKVEEEQNKSKKKAQQAAADTGRNSQVSQNYPIVQNLQGQMVHQSISPRTLNAWVKVVEEKAFSPEVIPMFSALSEGATPQDLNTMLNTVGGHQAAMQMLKETINEEAAEWDRLHPVQAGPVAPGQIRDPRGSDIAGTTSTLQEQITWMTNNPPIPVGEIYKRWIILGLNKIVRMYSPISILDIRQGPKEPFRDYVDRFYKTLRAEQASQDVKNWMTETLLVQNANPDCRTILKALGPAATLEEMMTACQGVGGPGHKARVLAEAMSQATNSATIMMQKGNFRNQRRTVKCFNCGKEGHIAKNCRAPRKKGCWKCGREGHQMKDCTERQANFLGKIWPSHSGRPGNFLQSRPEPTAPPEESFRFGEETTPSQKKEQIDKELYPPLASLKSLFGNDPSSQ

SEQ ID NO: 31 - protein, 500 aa, Human immunodeficiency virus
MGARASILSGGQLDKWEKIRLRPGGKKKYKFRHIVWASRELERFAVNPSLLETSEGCRQILGQLQPSLQTGSEELKSLYNTVAVLYCVHQRIEIKDTKDALDKIEEEQNKSKKKAQQAAADTGNSSQVSQNYPVVQNLQGQMVHQAISPRTLNAWVKVIEEKAFSPEVIPMFSALSEGATPGDLNTMLNTVGGHQAAMQMLKETINEEAAEWDRLHPVQAGPVAPGQMREPRGSDIAGTTSTLQEQIGWMTSNPPIPVGEIYKRWIILGLNKIVRMYSPVSILDIRQGPKEPFRDYVDRFYKTLRAEQASQEVKNWMTETLLVQNANPDCKTILKALGPGATLEEMMTACQGVGGPSHKARVLAEAMSQVTNSATIMMQRDNFKNQRRIVKCFNCGKVGHIAKNCRAPRKKGCWKCGKEGHQMKDCTERQANFLGRIWPSHKGRPGNFLQSRPEPSAPPEESFRFGEEAAAPSQKQEPIDKEMYPLASLRSLFGNDPSSQ

SEQ ID NO: 32 - protein, 500 aa, Human immunodeficiency virus; identical to SEQ ID NO: 26

SEQ ID NO: 33 - protein, 509 aa, Human immunodeficiency virus
MGARASVLSGGELDRWEKIRLRPGGKKQYKLKHIVWASRELERFALNPGLLETSEGCRQILEQLQPSLQTGSEEIKSLYNTVAVLFCVHQRIDVKDTKEALDKIEEEQNKSKKKAQQAAAATGNSNPGSSQVSQNYPIVQNMQGQMVHQPISPRTLNAWVKVVEEKAFSPEVIPMFSALAEGATPQDLNTMLNTVGGHQAAMQMLKETINEEAAEWDRLHPVHAGPIAPGQIREPRGSDIAGTTSNLQEQIAWMTHNPPIPVGEIYKRWIILGLNKIVRMYSPTSILDIKQGPKEPFRDYVDRFYRTLRAEQASQEVKNWMTETLLVQNANPDCKTILKALGPAATLEEMMTACQGVGGPGHKARVLAEAMSQVTNSATIMMQRGNFRNQRKIVKCFNCGKEGHIARNCRAPRKKGCWKCGKEGHQMKDCSERQANFLGKIWPSHKGRPGNFLQSRPEPTAPPAESFLFGEETTTPSQKQEPIKQEPIDKELYPLASLKSLFGNDPSSQ

SEQ ID NO: 34 - protein, 509 aa, Human immunodeficiency virus
MGARASILSGGELDRWEKIRLRPGGKKKYKLKHIVWASRELERFAVNPGLLETSEGCRQILRQLQPSLQTGSEELKSLYNTVATLYCVHQRIDVKDTKEALDKIEEEQNRSKKQAQQAAADTGNSSSQAHSSQVSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNPRKTVKCFNCGKDGHIARNCRAPRKKGCWKCGKEGHQMKDCNERQANFLGKIWPSHKGRPGNFLQSRPEPSAPPAESFKFGEETTTPSQKQEPIDKEMYPLASLKSLFGNDPLSQ

SEQ ID NO: 35 - protein, 501 aa, Human immunodeficiency virus
MGARASVLSGGELDRWEKIRLRPGGKKKYKLKHIVWASRELERFAVNPGLLETSAGCRQILGQLQPSIQTGSEELKSLYNTVATLYCVHQKIDVKDTKEALEKIEEEQNKSKKKAQQAAADTGNSSQVSQNYPIVQNMQGQMVHQAISPRTLNAWVKVIEEKAFSPEVIPMFVALSEGATPQDLNTMLNTVGGHQAAMQMLKETINEEAAEWDRAHPVHAGPVAPGQMREPRGSDIAGTTSTLQEQIGWMTQNPPIQVGEIYKRWIILGLNKIVRMYSPVSILDIRQGPKEPFRDYVDRFYKTLRAEQASQEVKNWMTETLLVQNANPDCKTILKALGPGATLEEMMTACQGVGGPGHKARVLAEAMSQIATPPAIMMQRGNFRGQRKVVKCFNCGKEGHIAKNCRAPRKRGCWKCGKEGHQMKDCTERQANFLGKIWPSSKGRPGNFLQSRPEPTAPPEESFRFGEETTTPPQKQEPPRDKELYPLASLRSLFGNDPSSQ

SEQ ID NO: 36 - protein, 521 aa, Human immunodeficiency virus
MGARASILSGGELDKWEKIRLRPGGKKKYKLKHIVWASRELERFAVNPGLLETSEGCRQILEQLQPSLQTGSEELKSLYNTIAVLYCVHQRIEVKDTKEALDKIEEEQNKSKKRAQQAAAQQAAAAADTGNRNQVSQNYPIVQNLQGQMVHQAISPRTLNAWVKVVEEKAFSPEVIPMFTALSEGATPQDLNTMLNTVGGHQAAMQMLKETINEEAADWDRTQPVHAGPIAPGQMREPRGSDIAGTTSTLQEQVAWMTSNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPSHKARVLAEAMSQVTNSATIMMQRGNFRNQRKTVKCFNCGKEGHIAKNCRAPRKKGCWKCGREGHQMKDCTERQANFLGRIWPSHKGRPGNFLQSRPEPTAPLEESFRSRPEPTAPPAESFRFGEEAAAPSQKREPTDQELYPLASLKSLFGNDPSSQ

SEQ ID NO: 37 - protein, 501 aa, Human immunodeficiency virus
MGARASVLSGGELDRWEKIRLRPGGRKKYQLKHIVWASRELERFALNPGLLETSEGCRRILGQLQPSLQTGSEELRSLYNTVATLYCVHQKIDVKDTKEALDKIEEEQNKSKKKAQQAAAADTGNSNQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGNFRSQRKTVKCFNCGKEGHIAKNCRAPRKRGCWKCGKEGHQMKDCTERQANFLGRIWPSHKGRPGNFLQSRPEPTAPPEESFRFGEETTTPPQNPEMRDKELYPLASLRSLFGNDPSSQ

SEQ ID NO: 38 - protein, 499 aa, Human immunodeficiency virus
MGARASVLSGGELDRWEKIRLRPGGKKKYRLKHVVWASRELERFAVNPGLLETSEGCRQILGQLQPSLKTGSEELRSLFNTVAVLYCVHQKIDVKDTKEALEKIEEEQNKSKQKTQQAAAGGNSSQVSQNYPIVQNMQGQMVHQAISPRTLNAWVKVVEEKAFSPEVIPMFSALSEGATPQDLNTMLNTVGGHQAAMQMLKETINEEAAEWDRLHPVQAGPVAPGQMRDPRGSDIAGTTSTLQEQIGWMTSNPPIPVGEIYKRWIILGLNKIVRMYSPTSILDIKQGPKEPFRDYVDRFYKTLRAEQASQEVKHWMTETLLVQNANPDCKTILKALGPGATLEEMMTACQGVGGPGHKARVLAEAMSQVTNSATIMMQKGNFKNQRKIVKCFNCGKEGHIARNCRAPRKKGCWKCGKEGHQMKDCTERQVNFLGKIWPSHKGRPGNFLQNRPEPTAPPEESFRFGEETTTPAQKQEPIDKELYPLASLKSLFGNDPSSQ

SEQ ID NO: 39 - protein, 500 aa, Human immunodeficiency virus
  variant (383)..(383): Xaa can be any naturally occurring amino acid
MGARASVLSGGKLDRWEKIRLRPGGKKQYKLKHIVWASRELERFAINPGLLETSEGCKQIMEQIQPALQTGSEELRSLYNTIAVLYCVHQGIDVKDTKEALDKIEEEQNKSKKKAQQAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASAEVKNWMTETLLVQNANPDCKTILKALGPAATLEEMMTACQGVGGPGHKARVLAEAMSQVTNSATIMMQKGNXRSQKRMIKCFNCGKEGHIARNCRAPRKKGCWKCGREGHQMKDCTERQANFLGKIWPSSKGRPGNFLQSRPEPTAPPEESFRFGEEMTTPSQKQEPIDKEMYPLASLKSLFGNDPSSQ

SEQ ID NO: 40 - protein, 509 aa, Human immunodeficiency virus
  variant (50)..(50): Xaa can be any naturally occurring amino acid
  variant (82)..(82): Xaa can be any naturally occurring amino acid
  variant (104)..(104): Xaa can be any naturally occurring amino acid
  variant (135)..(135): Xaa can be any naturally occurring amino acid
  variant (183)..(183): Xaa can be any naturally occurring amino acid
  variant (261)..(261): Xaa can be any naturally occurring amino acid
  variant (288)..(288): Xaa can be any naturally occurring amino acid
  variant (301)..(301): Xaa can be any naturally occurring amino acid
  variant (335)..(335): Xaa can be any naturally occurring amino acid
  variant (340)..(340): Xaa can be any naturally occurring amino acid
  variant (379)..(379): Xaa can be any naturally occurring amino acid
  variant (398)..(398): Xaa can be any naturally occurring amino acid
  variant (492)..(492): Xaa can be any naturally occurring amino acid
MGARASILSGGQLDRWEKIRLRPGGRKKYKLKHLVWASRELERFAVNPGXLETSEGCRQILEQLQPSLKTGSEELRSLFNTXATLYCVLQRIEIKDTKEALEKXEEEQNKSKKKTQQAAAAADTGNRSPVSQGSXQVSQNYPIVQNLQGQMVHQPLSPRTLNAWVKVIEEKAFSPEVIPMFSXLSEGATPQDLNTMLNTVGGHQAAMQMLKETINEEAAEWDRLHPVHAGPAAPGQMREPRGSDIAGTTSTLQEQIGWMTXNPPIPVGEIYKRWIILGLNKIVRMYSXVSILDIRQGPKEXFRDYVDRFYKTLRAEQATQEVKNWMTETLLVQNXNPDCXTILKALGPAATLEEMMTACQGVGGPGHKARVLAEAMSQXTGSATIMMQKGNFRNQRKXVKCFNCGKEGHIARNCRAPRKKGCWKCGKEGHQLKDCTERQANFLGKIWPSHKGRPGNFLQSRPEPTAPPEESFRFGEETAMPSQKQEPIDKEXYPLASLKSLFGNDPSSQ

SEQ ID NO: 41 - protein, 497 aa, Human immunodeficiency virus
  variant (114)..(114): Xaa can be any naturally occurring amino acid
  variant (258)..(258): Xaa can be any naturally occurring amino acid
  variant (381)..(381): Xaa can be any naturally occurring amino acid
MGARASVLSGGELDRWEKIRLRPGGKKQYKLKHIVWASRELERFAINPGLLETSEGCKQIIEQLQPSLQVGSEEIKSLYNTVATLYCVHKKIDVKDTKEALEKIEEEKNRSKKXAQQAAADSSQVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEXYKRWIILGLNKIVRMYSPVSILDIRQGPKEPFRDYVDRFYKTLRAEQCTQDVKNWMTETLLVQNANPDCKTILKALGPAATLEEMMTACQGVGGPSHKARVLAEAMSQATTPAAIMMQRGNFXNQRKTVKCFNCGREGHIAKNCRAPRKKGCWKCGKEGHQMKDCTERQANFLGKIWPSNKGRPGNFLQSRPEPTAPPEESFRFGEETTTPSQKQEPRDKDLYPLASLKSLFGNDPSSQ

SEQ ID NO: 42 - protein, 504 aa, Human immunodeficiency virus
  variant (75)..(75): Xaa can be any naturally occurring amino acid
  variant (330)..(330): Xaa can be any naturally occurring amino acid
  variant (435)..(435): Xaa can be any naturally occurring amino acid
MGARASVLSGGELDRWEKIRLRPGGKKRYKLKHIVWASRELERFAVNPGLLETSEGCRQILGQLQPALQTGSEEXRSLYNTVATLYCVHQRIEVKDTKEALDKIEEEQNKSKKKAQQAAPQAAAGAGNNSQVSYNYPIVQNIQGQMVHQAISPRTLNAWVKVIEEKAFSPEVIPMFSALSEGATPQDLNTMLNTVGGHQAAMQMLKETINEEAAEWDRVHPVHAGPTAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNXNPDCKTILKALGPGATLEEMMTACQGVGGPSHKARVLAEAMSQAQSSANMMMQRGNFRNQRKTVKCFNCGKEGHIAKNCRAPRKKGCWKCGKEGHQMKDCTERQXNFLGKLWPSHKGRPGNFLQSRPEPTAPPEESFKFGGETTTPPQKQEPIDKEMYPLASLRSLFGNDPSSQ

SEQ ID NO: 43 - protein, 510 aa, Human immunodeficiency virus
  variant (90)..(90): Xaa can be any naturally occurring amino acid
  variant (139)..(139): Xaa can be any naturally occurring amino acid
  variant (163)..(163): Xaa can be any naturally occurring amino acid
  variant (169)..(169): Xaa can be any naturally occurring amino acid
  variant (368)..(368): Xaa can be any naturally occurring amino acid
MGARASILSGGELDRWEKIRLRPGGKKQYKLKHIVWASRELERFAVNPGLLETSEGCRQILEQLQPSLPTGSEEIKSLYNTVATLYCVHXRIDVKDTKEALDKIEEEQNKSKIKAQQAAAQQAAAATGSSQVSQNYPIXQNLQGQMVHQPISPRTLNAWVKVXEEKAFXPEVIPMFSALSEGATPQDLNTMLNTVGGHQAAMQMLKETINDEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLXEAMSQVQNSNAIMMQRGNFKTQRKIVKCFNCGKEGHIARNCRAPRKRGCWKCGKEGHQMKDCTTERQANFLGKIWPSHKGRPGNFLQSRPEPTAPPEESFRFGEEAAAPSQKQEPMHKEKQEPRDKELYPLASLRSLFGNDP

SEQ ID NO: 44 - protein, 503 aa, Human immunodeficiency virus
  variant (119)..(119): Xaa can be any naturally occurring amino acid
  variant (140)..(140): Xaa can be any naturally occurring amino acid
  variant (258)..(258): Xaa can be any naturally occurring amino acid
  variant (261)..(261): Xaa can be any naturally occurring amino acid
  variant (268)..(268): Xaa can be any naturally occurring amino acid
MGARASVLSGGELDRWERIRLRPGGNKKYKLKHIVWASRELERFAVNPGLLETAEGCRQILGQLQPSLQTGSEELRSLYNTVAVLYCVHQKIEVKDTKEALDKVEEEQNKCKNKAQQAXAGTGNNSQASQNYPIVQNIQXQMVHQPLSPRTLNAWVKVVEEKAFSPEVIPMFSALSEGATPQDLNTMLNTVGGHQAAMQMLKETINEEAAEWDRLHPVHAGPIAPGQIREPRGSDIAGTTSTLQEQIAWMTNNPPIPXGEXYKRWIIXGLNKIVRMYSPTSILDIKQGPKEPFRDYVDRFYKTLRAEQASQEVKNWMTETLLVQNSNPDCKTILKALGPAATLEEMMTACQGVGGPSHKARILAEAMSQVTNSAAIMMQKGNFRKQRNSVKCFNCGKEGHVARNCRAPRKKGCWKCGKEGHQMKDCTERQANFLGKIWPSHKGRPGNFLQNRPEPTAPPAPPEESFRFGEETTTPSQKQEPIDKELYPLASLKSLFGNDPLSQ

SEQ ID NO: 45 - protein, 505 aa, Human immunodeficiency virus
MGARASVLSGGELDRWEKIRLRPGGKKKYRLKHIVWASRELERFAVNPGLLETSEGCRQILGQLQPSLQTGSEELKSLYNTIAVLYCVHQRIDVKDTKEALEKIEEEQNKSKKRAQQAAADTGNSSQVSQNYPIVQNLQGQMVHQPIAPRTLNAWVKVVEEKAFSPEVIPMFAALSEGATPQDLNTMLNTVGGHQAAMQMLKETINEEAAEWDRLHPAQAGPVAPGQMRDPRGSDIAGTTSTLQEQIGWMTSNPPIPVGEIYKKWIIIGLNKIVRMYSPTSILDIKQGPKEPFRDYVDRFYKTLRAEQASQEVKNWMTETLLVQNANPDCKTILKALGPAATLEEMMSACQGVGGPSHKAKVLAEAMSQVTNSATATMMMQRGNFRNQRKPVKCFNCGKEGHIARNCRAPRKKGCWKCGKEGHQMKDCTERQANFLGKIWPSYKGRPGNFLQSRPEPTAPPAPPEESFRFGEETTTPLQKQEQTDKELYPLASLKSLFGNDPSST

SEQ ID NO: 46 - protein, 501 aa, Human immunodeficiency virus
MGARASVLRGGELDRWEKIRLRPGGKKKYQLKHIVWASRELERFAVNPSLLETSEGCRQILRQLQPSLQTGSEELKSLYNTIAVLYCVHQKIEIKDTKEALDKIEEEQNESKKKAQRQAAEADPGKNSQVSQNYPIVQNLQGQMVHNPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGDIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMNQANSAAIMMQRGNFKNQRRTIKCFNCGREGHLARNCRAPRKKGCWKCGKEGHQMKDCTERQANFLGKIWPSLKGRPGNFLQNRPEPSAPPAESFGFGEETTTPPQKQEPIDKELYPLTSLKSLFGSDPSSQ

SEQ ID NO: 47 - protein, 500 aa, Human immunodeficiency virus
MGARASVLSGGKLDRWEKIRLRPGGKKRYKLKHIVWASRELERFAVNPGLLETSEGCRQILGQLQPALKTGSEELKSLYNTVATLYCVHQSIDVRDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGVTSTLQEQIGWMTHNPPVPVGEIYKKWIIMGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMGQVTNSATIMMQKGNFRNQRKTVKCFNCGKDGHIARNCRAPRKKGCWKCGREGHQMKDCTERQANFLGKIWPSHKGRPGNFLQSRPEPTAPPAPPEESFRFGEEAAAPPQKQEPIDKELYPLASLRSLFGNDP

SEQ ID NO: 48 - protein, 502 aa, Human immunodeficiency virus
MGARASVLSGGELDRWEKIRLRPGGKKTYKLKHLVWASRELERFAVNPGLLETSEGCRQILGQLQPSLQTGSEELKSLFNTVATLYCVHQRIQVRDTKEALDKIEEEQNKSKKKAQQAAAAADTGNSSNVSQNYPIVQNMQGQMVHQPISPRTLNAWVKVIEEKAFSPEVIPMFSALSEGATPGDLNTMLNTVGGHQAAMQMLKETINEEAAEWDRLHPVQAGPVAPGQIREPRGSDIAGTTSTLQEQIAWMTNNPPIPVGDIYKRWIILGLNKIVRMYSPTSILDIKQGPKEPFRDYVDRFYKTLRAEQASQEVKNWMTETLLVQNANPDCKTILKALGPACTLEEMMTACQGVGGPSHKARVLAEAMSQVTNSATIMMQRGNFRDQRKTVKCFNCGKEGHIARNCRAPRKKGCWKCGQEGHQMKDCTGRQANFLGKIWPSHKGRPGNFLQSRPEPTAPPAESFTFGEEAATPSQKQETRDKELYPLASLRSLFGNDPSSQ

SEQ ID NO: 49 - protein, 504 aa, Human immunodeficiency virus
  variant (129)..(129): Xaa can be any naturally occurring amino acid
  variant (228)..(228): Xaa can be any naturally occurring amino acid
MGARASVLSGGELDRWEKIRLRPGGKKKYRLKHIVWASRELERFAVNPGLLETSEGCRQILGQLQPSLQTGSEELRSLYNTIATLYCVHQRIDIKDTKEALDKIEEEQNKSKKKVQQAAAAADTGSSSXQVSQNFPIVQNLQGQMVHQALSPRTLNAWVKVVEEKAFSPEVIPMFSALSEGATPQDLNTMLNTVGGHQAAMQMLKETINEEAAEWDRLHPVHAGPIAXGQMREPRGSDIAGTTSTLQEQIGWMTHNPPIPVGEIYKRWIILGLNKIVRMYSPTSILDIKQGPKEPFRDYVDRFYRTLRAEQASQEVKNWMTETLLVQNSNPDCKTILKALGPAATLEEMMTACQGVGGPGHKARVLAEAMSQVTNPTNIMMQRGNFRNQRKPVKCFNCGKEGHIARNCRAPRKRGCWKCGKEGHQMKDCTERQANFLGKIWPSQKGRPGNFPQGRLEPTAPPEESFRSGEETATPSQRQETVDKELYPPLTSLRSLFGSDPSSQ

SEQ ID NO: 50 - protein, 508 aa, Human immunodeficiency virus
  variant (84)..(84): Xaa can be any naturally occurring amino acid
MGARASVLSGGELDRWEKISLRPGGKKKYRLKHLVWASRELERFAVNPGLLETSDGCRQIMEQLQPALRTGSEELKSLFNTVAXLYCVHQRIQIKDTKEALDKIEEEQNKSKKKAQQAAADTGNNSQGNNSQVSQNYPIVQNMQGQMVHQAMSPRTLNAWVKVIEEKAFSPEVIPMFAALSEGATPQDLNTMLNTVGGHQAAMQMLKETINEEAAEWDRMHPVHAGPLPPGQMREPRGSDIAGTTSNLQEQIGWMTSNPPIPVGEIYKRWIILGLNKIVRMYSPSSILDIKQGPKEPFRDYVDRFYKTLRAEQASQEVKNWMTETLLVQNSNPDCKTILKALGPAATLEEMMTACQGVGGPSHKARVLAEAMSQVNNSAAIMMQKGNFRNQKKIPKCFNCGKEGHIARNCRAPRKRGCWKCGKEGHQMKDCTERQANFLGKIWPSHKGRPGNFLQSRPEPTAPPAPPEESFRFGEETTTPSQKQESGNKELYPLASLRSLFGSDPSSQ

SEQ ID NO: 51 - protein, 506 aa, Human immunodeficiency virus
MGARASVLSGGKLDAWEKIRLRPGGNKRYRLKHIVWASRELERFAVNPGLLETAEGCRQIIGQLQPSLKTGSEELRSLFNTVATLYCVHQRIEVKDTKEALDKIEEEQNKCKEKAQQAAANTGNSGQVSQNYPIVQNLQGQMVHQAISPRTLNAWVKVIEEKAFSPEVIPMFSALSEGATPQDLNTMLNTVGGHQAAMQMLKETINEEAAEWDRLHPVQAGPNPPGQMREPRGSDIAGTTSTLQEQIAWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQATNTAAIMMQRGNFRNQRKTVKCFNCGKEGHIARNCRAPRKKGCWKCGKEGHQMKECTERQANFLGKVWPSHKGRPGNFLQSRLEPTAPPAESFRFGEETTTPQQKQAPPQKQEPTDKELYPLTSLRSLFGNDPSSQ

SEQ ID NO: 52 - protein, 506 aa, Human immunodeficiency virus
MGARASVLSGGELDRWEKIRISPGGKKKYRLKHIVWASRELERFAVNPGLLETAQGCRQILEQLQPSLQTGSEEFRSLYNTIATLYCVHQKIEVKDTKEALDQIEEEQTKSKKKAQQAAAAQQAAAAAETSSQVSQNYPIVQNMQGQMVHQAISPRTLNAWVKVVEEKAFSPEVIPMFSALSEGATPQDLNTMLNTVGGHQAAMQMLKDTINEEAAEWDRLHPVHAGPIAPGQMREPKGSDIAGTTSTLQEQIGWMTHIPPIPVGEIYKRWIILGLNKIVRMYSPTSILDIKQGPKEPFRDYVDRFYRTLRAEQASQDVKNWMTETLLVQNANPDCKTILKALGPAATLEEMMTACQGVGGPGHKARVLAEAMSQVTGSATIMMQKGNFRNQRKMVKCFNCGKEGHIARNCRAPRKRGCWKCGKEGHQMKDCTERQANFLGKIWPSHKGRPGNFLQSRPEPTAPPEESFRSGEETTAPSQKQEPKDKELYPLASLRSLFGNDPSSQ

SEQ ID NO: 53 - protein, 508 aa, Human immunodeficiency virus
MGARASVLSGGKLDKWEKIRLRPGGKKQYKLKHIVWASRELERFAVNPGLLETPEGCRQILGQLQPSLQTGSEELKSLFNTIAVLYCVHQNIEVRDTKEALDKIEEEQNKSKKKAQQAAADTGNSSQVRNSGQVSQNYPIVQNLQGQMVHQAISPRTLNAWVKVIEEKAFSPEVIPMFTALSEGATPQDLNTMLNTVGGHQAAMQMLKETINEEAAEWDRMHPVHAGPAAPGQMREPRGSDIAGTTSTLQEQIAWMTGNPPVPVGEIYKRWIILGLNKIVRMYSPTSILDIRQGPKEPFRDYVDRFYKTLRAEQASQEVKNWMTETLLVQNSNPDCKTILKALGPGATLEEMMTACQGVGGPGHKARVLAEAMSQVTNSNTIMMQRGNFRNQRKTVKCFNCGKEGHIARNCRAPRKKGCWKCGKEGHQMKDCTERQANFLGKIWPSHKGRPGNFLQNRPEPSAPPEESFRFGEETITPSQKQEQTDRDKEKYPLTSLRSLFGNDPLSQ

SEQ ID NO: 54 - protein, 504 aa, Human immunodeficiency virus
MGARASVLSGGELDRWERIRLRPGGKKKYRLKHIVWASRELERFAVNPGLLETSEGCRQIIRQLQPSLQTGSEELRSLYNTVATLYCVHQKIDVKDTKEALDKIEEEQNKSKKMAQQAAADTGNSSSQVSQVSQNYPIVQNIQGQMVHQALSPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTHNPPIPVGEIYKRWIILGLNKIVRMYSPASILDIKQGPKEPFRDYVDRFYKTLRAEQASQEVKNWMTETLLVQNANPDCKTILKALGPAATLEEMMTACQGVGGPSHKARVLAEAMSQVTNSNTIMMQRGNFRNQKRTVKCFNCGKDGHIARNCRAPRKRGCWKCGKEGHQMKECTERQANFLGKVWPSHKGRPGNFLQSRPEPTAPPEKSFRFGEETAAPPQKQEPIDKGLYPSASLRSLFGNDPSSQ

SEQ ID NO: 55 - protein, 500 aa, Human immunodeficiency virus
MGARASVLSGGELDRWEKIRLRPGGKKQYRLKHIVWASRELERFAVNPGLLETSEGCRQILRQIQPSLQTGSEELKSLYNTVAVLYCVHQRIIVRDTKEALDKIEEEQSKSKKKEQQAAADTGNSSQVSQNYPIVQNLQGQMVHQAISPRTLNAWVKVIEEKAFSPEVIPMFTALSEGATPQDLNTMLNTVGGHQAAMQMLKETINEEAAEWDRLHPVHAGPIAPGQMREPRGSDIAGTTSTLQEQIGWMTSNPPVPVGEIYKTWIILGLNKIVRMYSPVSILDIRQGPKEPFRDYVDRFYKTLRAEQASQEVKNWMTETLLIQNSNPDCKTILKALGPGATLEDMMTACQGVGGPGHKARVLAEAMSQMTNSATIMMQKGNFRSQGKIVKCFNCGKQGHIARNCRAPRKKGCWRCGKEGHQMKECTEGQANFLGKIWPSHKGRPGNFLQSRPEPTAPPEESFRSGEETTSPSQKQETIDKTLYPSASLRSLFGNDPSSQ

SEQ ID NO: 56 - protein, 503 aa, Human immunodeficiency virus
MGARASVLSGGELDRWEKIRLRPGGKKKYRLKHIVWASRELERFAVIPGLLETAEGCKQILEQLQPSLRTGSEELKSLFNTIAVLFCVHQRIEVKDTKEALDKIEEEKNKSKKRAQQAAADTGNSSQVSSQVSQNYPIVQNLQGQMVHQPITPRTLNAWVKVVEEKSFSPEVIPMFSALSEGATPQDLNTMLNTIGGHQAAMQMLKETINEEAAEWDRLHPVHAGPIAPGQMREPRGSDIAGTTSTLQEQIGWITHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNPPTIMMQRGNFRNQGRIVKCFNCGKEGHIAKNCRAPRKKGCWKCGKEGHQMKDCTERQANFLGKIWPSHKGRPGNFLQSRPEPTAPPEESFRFGEETTPSQKQEQIDKELYPSASLKSLFGNDPSSQ

SEQ ID NO: 57 - protein, 501 aa, Human immunodeficiency virus
MGARASVLSGGKLDKWEKIRLRPGGKKQYRLKHIVWASRELERFALNPGLLETAEGCKQILEQLQPALRTGTEELRSLNNTVAVLYCVHRQIEVRDTKEALDKIEEEQNKSKKKAQQAEADTGNSRQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIIMGLNKIVRMYSPISILDIRQGPKEPFRDYVDRFYKTLRAEQASQEVKNWMTETLLVQNANPDCKNILKALGPGATLEEMMTACQGVGGPSHKARVLAEAMGQITSSATVMMQRGNFRGQRKIVKCFNCGKEGHIARNCKAPRKRGCWKCGQEGHQMKDCTERQANFLGKIWPSHKGRPGNFPQSRLEPTAPPAESFRFGEETTTPSQKQGTMDKEHPSPLASLRSLFGNDPLSQ

SEQ ID NO: 58 - protein, 507 aa, Human immunodeficiency virus
MGARASVLSGGELDRWEKIRLRPGGKKKYRLKHVVWASRELERFAVNPGLLETSEGCRQILGQLQPSLQTGSEELRSLYNTVAVLYCVHQKIDVRDTKEALEKVEEEQNKSKEKAQTAAQKAAADTKNSSQVSQNYPIVQNIQGQMVHQPISPRTLNAWVKVVEEKAFSPEVIPMFSALSEGATPQDLNTMLNTVGGHQAAMQILKETINEEAADWDRLHPVQAGPVAPGQMREPRGSDIAGTTSTLQEQIGWMTSNPPIPVGEIYKRWIIMGLNKIVRMYSPVGILDIRQGPKEPFRDYVDRFYKTLRAEQASQDVKNWMTETLLVQNANPDCKTILKALGPAATLEEMMTACQGVGGPGHKARVLAEAMSQMTNSATIMMQKGNFRNQRKIVKCFNCGKEGHIARNCRAPRKRGCWKCGKEGHQMKDCTERQANFLGKIWPSHKGRPGNFLQNRPEPTAPPAPPEESFKFGEETTTPPQKQEPKDKELYPLTSLRSLFGNDPLSQ

SEQ ID NO: 59 - protein, 504 aa, Human immunodeficiency virus
  variant (113)..(113): Xaa can be any naturally occurring amino acid
  variant (130)..(130): Xaa can be any naturally occurring amino acid
  variant (250)..(250): Xaa can be any naturally occurring amino acid
MGARASVLSGGKLDKWERIRLRPGGKKKYKLKHIVWASRELERFAVNPGLLETSEGCRRILGQLQPSLQTGSEELKSLYNTIATLCCVHQGIEVKDTKEALDKIEEEQNKSKXKTQQAAAAADTGNSGQXSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIXWMTNNPPIPVGEIYKRWIIMGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNSTAIMMQKGNFRNQRKIVKCFNCGKEGHIARNCRAPRKKGCWKCGKEGHQMKDCTERQANFLGKIWPSHKGRPGNFLQSRPEPTAPPEESFRFGEETTTPPQKQKQEPVDKELYPLASLRSLFGNDPSSQ

SEQ ID NO: 60 - protein, 501 aa, Human immunodeficiency virus
MGARASVLSGGELDKWERIRLRPGGKKKYQLKHIVWASRELERFSINPGLLETSEGCRQILRQLQPSLQTGSEELKSLFNTVATLYCVHQKIDVKDTKEALEKIEEEQNKSKKKAQQAEADTGSNNQVSQNYPIVQNLQGQMVHQAISPRTLNAWVKVIEEKAFSPKVIPMFSALSEGATPQDLNTMLNTVGGHQAAMQMLKETINEEAAEWDRLHPVHAGPAAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARILAEAMCQVTNANTIMMQRGNFKNQRKTVKCFNCGKEGHIARNCRAPRKKGCWKCGGEGHQMKDCTERQANFLGKIWPSHKGGRPGNFLQSRPEPTAPPEESFRFGEETTTPSQKQEPINKELYPLASLRSLFGNDPSSQ

SEQ ID NO: 61 - protein, 504 aa, Human immunodeficiency virus
MGARASVLSGGDLDRWEKIRLRPGGKKKYQLKHIVWASRELERFAINPGLLETSEGCRQIMSQLQSSLQTGSEELRSLYNTVATLYCVHQKIDVKDTKEALDIVEEEQNKSKKKAQQAAADTGNSSSQVSQNYPIVQNLQGQMVHQALSPRTLNAWVKVVEEKAFSPEVIPMFSALSEGATPQDLNTMLNTVGGHQAAMQMLKETINEEAAEWDRLHPAQAGPVQPGQIRDPRGSDIAGTTSTLQEQIAWMTHNPPIPVGEIYKRWIILGLNKIVRMYSPSSILDIKQGPKEPFRDYVDRFYKTLRAEQASQEVKNWMTETLLVQNSNPDCKTILKALGPGATLEEMMTACQGVGGPSHKARVLAEAMSQVNNSASVMMQKGNFKNQKRTVKCFNCGKVGHIARNCRAPRRKGCWKCGKEGHQMKECSEKQANFLGKVWPSHKGRPGNFLQSRPEPTAPPAPSEESFRFGEETAAPPQKQEPIDQGLYPLASLRSLFGNDPSSQ

SEQ ID NO: 62 - protein, 510 aa, Human immunodeficiency virus
MGARASVLSGGELDRWEKIRLRPGGKKKYRLKHIVWASRELERFAVNPGLLETSEGCRKILGQLQPSLQTGSEELKSLFNTVATLYCVHQKIDVKDTKEALDRIEEEQNKSKKKAQPAAAAADTGNNSQVSQNYPIVQNLQGQMVHQALSPRTLNAWVKVVEEKAFSPEVIPMFTALSEGATPQDLNTMLNTVGGHQAAMQMLKETINEEAAEWDRLHPVQAGPIAPGQIREPRGSDIAGTTSNLQEQIAWMTNNPPIPVGEIYKRWIILGLNKIVRMYSPTSILDIKQGPKEPFRDYVDRFYKTLRAEQASQEVKNWMTETLLVQNANPDCKTILKALGPGATLEEMMTACQGVGGPGHKARVLAEAMSQVNSATIMMQKGNFRNQRKTVKCFNCGKEGHIARNCRAPRKRGCWKCGKEGHQMKDCTERQANFLGKIWPSHKGRPGNFLQSRPEPTAPPEESFRFGEETATPSQKQEPATPSQKQEQIDKELYPLTSLRSLFGNDPSSQ

SEQ ID NO: 63 - protein, 506 aa, Human immunodeficiency virus
MGARASVLSGGKLDAWEKIRLRPGGKKKYRLKHLVWASRELERFAVNPSLLETPEGCKQILVQLQPSLQTGSEELKSLYNTVATLYCVHSRIEVKDTKEALDKIEEEQNKSKKRTQQAAAADTGNSSQGSQVSHNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVCILDIRQGPKEPFRDYVDRFYKTLRAEQASQDVKNWMTETLLVQNSNPDCKTILKALGPAATLEEMMTACQGVGGPGHKARVLAEAMSHVTNPTNIMMQGGNFRSQKKMVKCFNCGKVGHIAKNCRAPRKRGCWKCGKEGHQMKDCNERQGQANFLGKIWPSYKGRPGNFLQNRTEPTAPPEEIFRFGEETTTPSQKQGPMDKEQYPLTSLRSLFGSDPSSQ

SEQ ID NO: 64 - protein, 500 aa, Human immunodeficiency virus
MGARASVLSGGELDRWEKIRLRPGGKKQYKLYHIVWASREIEGLAVNPGLLETSEGCREILGQLHPSLQTGSEEFKSLYNTVAVLYCVHQRIDVKDTKEALDKIEEEQNKSKKKAQQAAADTGNSSNSSQVSQNYPIVQNLQGQMVHQALSPRTLNAWVKVVEEKAFSPEVIPMFSALSEGATPQDLNTMLNTVGGHQAAMQILKETINEEAAEWDRLHPVHAGPIAPGQMREPRGSDIAGTTSTLQEQIGWMTNNPPIPVGEIYKKWIIMGLNKIVRMYSPVSILDIRQGPKEPFRDYVDRFYKTLRAEQASQEVKNWMTETLLVQNANPDCKTILKALGPGATLEEMMTACQGVGGPGHKARVLAEAMSQVTNPATIMIQKGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDREMYPSTSLKSLFGNDP

SEQ ID NO: 65 - protein, 505 aa, Human immunodeficiency virus
  variant (51)..(51): Xaa can be any naturally occurring amino acid
  variant (143)..(143): Xaa can be any naturally occurring amino acid
  variant (341)..(341): Xaa can be any naturally occurring amino acid
  variant (397)..(397): Xaa can be any naturally occurring amino acid
  variant (403)..(403): Xaa can be any naturally occurring amino acid
  variant (463)..(463): Xaa can be any naturally occurring amino acid
  variant (483)..(483): Xaa can be any naturally occurring amino acid
MGARASILSGGKLDKWEKIRLRPGGKKQYQLKHLVWASRELERFAVNPGLXETAQGCRQILQQLQPSLQTGTEELRSLYNTVATLYCVHQNIDVKDTKEALDRVEEEQNKSKKKAEQAAADTRSSSQVSQNYPIVQNLQGQMXHQPISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIAWMTNNPPIPVGDIYKRWIILGLNKIVRMYSPTSILDIKQGPKEPFRDYVDRFYKVLRAEQASQEVKNWMTETLLVQNANPDCKTILKALGPAXTLEEMMTACQGVGGPGHKARVLAEAMSQVTNSATIMMQKGNFRNQRKTVKCFNCGXEGHIAXNCRAPRKRGCWKCGQEGHQMKDCTERQANFLGKIWPSHKGRPGNFLQSRPEPSAPPEDSXRFAEQTATPQTATPSQKQEXIDKELYPLASLRSLFGNDPSSQ

SEQ ID NO: 66 - protein, 506 aa, Human immunodeficiency virus
MGARASVLSGGELDRWEKIRLRPGGKKKYKLKHIVWASRELERFAVNPSLLETSEGCRQILGQLQPSLQTGSEELKSLFNTVATLYCVHQRIDVKDTKEALDRIEEEQNKSKKKAQQAAAADTGNSSTGNGSKVSQNYPIVQNLQGQMVHQTLSPRTLNAWVKVIEEKAFSPEIIPMFTALSEGATPQDLNTMLNTVGGHQAAMQMLKETINEEAAEWDRLHPPQAGPVAPGQIRDPRGSDIAGTTSNLQEQIAWMTNNPPIPVGEIYKRWIILGLNKIVRMYSPVSILDIRQGPKEPFRDYVDRFYKTLRAEQASQEVKNWMTETLLVQNANPDCKTILKALGPGASLEEMMTACQGVGGPGHKARVLAEAMSQVTNSTAIMMQKGNFRNQRRTIKCFNCGKEGHLARNCRAPRKKGCWKCGKEGHQMKDCTERQANFLGKIWPSHKGRPGNFLQSRPEPTAPPEESFRFGEETTTPPQKQEPIDKEMYPLASLKSLFGNDPSSQ

SEQ ID NO: 67 - protein, 503 aa, Human immunodeficiency virus
MGARASVLSGGKLDAWEKIRLRPGGKKKYHLKHIVWASRELERFAVNPGLLETSEGCRQILQQLQPSLQTGSEELKSLYNTVAVLYCVHQRIEIKDTKEALDKIEEEQNKSKKKAQQAAADTGKSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQIREPRGSDIAGTTSTLQEQITWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQINPTTVMMQRGNFRNQRKTVKCFNCGKEGHIARNCRAPRKKGCWKCGQEGHQMKDCNERQANFLGKIWPSSKGRPGNFLQSRPEPTAPPAPPEESFRFGEETTTAPSQKQEPIDKGLYPLASLRSLFGNDPSSQ

SEQ ID NO: 68 - protein, 503 aa, Human immunodeficiency virus
MGARASVLSGGELDKWEKIRLRPGGKKKYRLKHLVWASRELERFAVNPGLLETSEGCRQILEQLQPALRTGSEELRSVYNTVATLYCVHQKIDVKDTKEALDKIEEEQNKSKKKAQQAAAAAADTGKNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSNVTNSTTIMMQKGNFRNQRKPVKCFNCGKEGHIAKNCRAPRKKGCWKCGKEGHQMKDCTERQANFLGKIWPSHKGRPGNFLQSRPEPTAPPEESFRFGEEKATPSQKQEPIDKELYPLASLRSLFGNDPSSQ

SEQ ID NO: 69 - protein, 501 aa, Human immunodeficiency virus
  variant (124)..(124): Xaa can be any naturally occurring amino acid
MGARASVLSGGELDRWEKIRLRPGGKKMYKLKHIVWASRELERFAVNPGLLETSEGCRQILAQLQPSLQTGSEELKSLFNAVAVLYCVHQRIDVKDTKEALDKIEEEQNKSKKKAQQAAAAADXGSSSQVSRNYPIVQNLQGQMVHQAISPRTLNAWVKVIEEKAFSPEVIPMFSALSEGATPQDLNTMLNTVGGHQAAMQMLKETINEEAAEWDRLHPVHAGPVAPGQMRDPRGSDIAGTTSTLQEQIGWMTGNPAIPVGEIYKRWIILGLNKIVRMYSPVSILDIRQGPKEPFRDYVDRFYKTLRAEQATQEVKNWMTETLLVQNANPDCKTILKALGPAATLEEMMSACQGVGGPSHKARVLAEAMSQATSAATIMMQKGNFRSQGKIKCFNCGKEGHISKNCRAPRKKGCWKCGKEGHQMKDCNERQANFLGKVWPSHKGRPGNFVQSRPEPSAPPAESFMFGEETTTPPQKQEPVDKELYPLASLKSLFGSDPSSQ

SEQ ID NO: 70 - protein, 502 aa, Human immunodeficiency virus
MGARASIISGGELDRWEKIRLRPGGNKKYRLKHLVWASRELERFAVNPGLLETSEGCRQIIGQLQPSLQTGSEELKSLYNTVATLYCVHLRIDVKDTKEALEKLEEEQNKSKKKAQQAAADTGKSSGNQVSQNYPIVQNLQGQHVHQAISPRTLNAWVKVIEEKAFSPEVIPMFSALSEGATPQDLNTMLNTVGGHQAAMQMLKDTINEEAADWDRLHPVHAGPIAPGQMREPRGSDIAGTTSTLQEQIGWMTNNPPIPVGEIYKRWIIIGLNKIVRMYSPVSILDIRQGPKEPFRDYVDRFYKTLRAEQASQDVKNWMTETLLVQNANPDCKTILKALGPAATLEEMMTACQGVGGPSHKARILAEAMSQVTNPTTIMMQRGNFRNQRRPIKCFNCGKEGHIAKNCRAPRKKGCWKCGKEGHQMKDCSERQANFLGKIWPSSKGRPGNFLQSRPEPSAPPEESFRFGEETTTPSQKQETVDKELYPLTSLKSLFGNDPSSQ

SEQ ID NO: 71 - protein, 501 aa, Human immunodeficiency virus
  variant (280)..(280): Xaa can be any naturally occurring amino acid
MGARASILSGGQLDRWEKIRLRPGGKKKYRLKHLVWASRELERFAVNPGLLETLDGCRQILGQLQPALQTGSEELRSLYNTVATLYCVHGGIEVKDTKEALDKIEEEQNKSKKKAQQAAADTGNSNSSPVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPVAPGQLREPRGSDIAGTTSTLQEQIAWMTNNPPIPVGDIYKRWIILGLNKIVRMYXPTSILDIKQGPKEPFRDYVDRFYKVLRAEQASQDVKNWMTETLLVQNANPDCKTILKALGPAATLEEMMTACQGVGGPSHKAKVLAEAMGQVTSSATIMMQKGNFRDQRKIVKCFNCGKTGHIARNCRAPRKKGCWKCGKEGHQMKECTERQANFLGKIWPSHKGRPGNFLQSRPEPTAPPAESFRFGEEATAPSPKPEPIDEMYPLASLKSLFGNDPSSQ

SEQ ID NO: 72 - protein, 499 aa, Human immunodeficiency virus
  variant (388)..(388): Xaa can be any naturally occurring amino acid
  variant (482)..(482): Xaa can be any naturally occurring amino acid
MGARASVLSGGKLDKWERIRLRPGGKKKYRLKHIVWASRELERFAVNPGLLETATGCRQILEQLQPALKTGSEELKSLFNTVATLYCVHQAIEVRDTKEALDKIEEEQNKSKNKAQQAAADAGNNNQVSQNYPIVQNLQGQMVHQAMTPRTLNAWVKVIEEKAFSPEVIPMFSALSEGATPQDLNTMLNTVGGHQAAMQMLKETINEEAAEWDRLHPVHAGPIAPGQLREPRGSDIAGTTSTLQEQIAWMTHNPPIPVGEIYKRWIILGLNKIVRMYSPSSILDIKQGPKEPFRDYVDRFYKTLRAEQASQEVKNWMTETLLVQNSNPDCKTILKALGPGATLEEMMTACQGVGGPSHKARVLAEAMSQANTTSIMMQRGNFRNQRKXVKCFNCGKEGHIAKNCRAPRKKGCWKCGKEGHQMKDCTERQANFLGKIWPSHKGRPGNFLQSRPEPTAPLEESFGFGEETITPPQKQEPIDKGXYPSVSLKSLFGNDPLSQ

SEQ ID NO: 73 - protein, 500 aa, Human immunodeficiency virus
MGARASVLSGGELDRWEKIRLRPGGKKKYRLKHIVWASRELERFAVNPGLLETSEGCRKILGQLQPSLQTGSEELKSLYNTIATLYCVHQKIEIKDTKEALDKIEEEQNKSKKKAQQAAADTGNSSSQVSQNYPIVQNIQGQMVHQPISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIEWMTHNPPIPVGEIYKRWIILGLNKIVRMYSPTSILDIRQGPKEPFRDYVDRFYKTLRAEQASQEVKNWMTETLLVQNSNPDCKTILKALGPGATLEEMMTACQGVGGPGHKARVLAEAMSQATNTNIMLQRGNFRNQRKTIKCFNCGKEGHLAKNCRAPRKKGCWKCGKEGHQMKDCTERQANFLGKIWPSLKGRPGNFLQSRLEPTAPPEESFRFGEETTTPSQKQEPTDKEVYPLTSLRSLFGNDPSST

SEQ ID NO: 74 - protein, 501 aa, Human immunodeficiency virus
MGARASVLSGGELDRWEKIRLRPGGKKKYKLKHIVWASRELERFAVNPGLLETSEGCRQILGQLQPSLQTGSEELKSLFNTIAVLYCVHQRIEVKDTKEALEKIEEEQNKSKKKVQQAAADSGNSDSQVSKNFPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMNQVTNPTSIMMQRGNFRNQRKTVKCFNCGKEGHIARNCRAPRKKGCWKCGKEGHQMKDCSERQANFLGKIWPSHKGRPGNFPQSRPEPSAPPEESFRFGEETTAPSLKQEPINKELYPLASLKSLFGNDPSSQ

SEQ ID NO: 75 - protein, 505 aa, Human immunodeficiency virus
MGARASVLSGGELDRWEKIRLRPGGKKKYRLKHIVWASRELERFAVNPGLLETASGCRQILEQLQPSLQTGSEELRSLYNTIAVLYCVHQKIEVKDTKEALDKIEEEQNKSKKKAQQAAAAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSSANSAAIMMQKGNFRNQRKTVKCFNCGKEGHIARNCRAPRKKGCWKCGKEGHQMKDCTERQANFLGKIWPSHKGRPGNFLQSRPEPTAPPAPPAESFRFGEETTTPPQKQEPIDKELYPLASLKSLFGNDPSSQ

SEQ ID NO: 76 - protein, 501 aa, Human immunodeficiency virus
MGARASILSGGKLDRWEKIRLRPGGKKQYKLIHIVWASREVERFAVNPGLLETSEGCRQILEQLQPSFQTGSEELRSLFNTIATLYCVHQNIDIKDTKEALDKIEEEQNKSKKRAQQAAAADTGNNKQVSQNYPIVQNMQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGINKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNPATIMIQKGNFRNQRKTVKCFNCGKEGHIAKNCRAPRKKGCWKCGKEGHQMKDCTERQANFLGKIWPSHKGRPGNFLQSRPEPTAPPEEIFRFGEETATPPQKQEPIDKELYPSASLRSLFGNDPSSQ

SEQ ID NO: 77 - protein, 503 aa, Human immunodeficiency virus
MGARASVLSGGKLDKWEKIRLRPGGKKTYKLKHIVWASRELERFAVNPGLLETAEGCRQIMGHLHPSLQTGSEELRSLYNAVATLYCVHQRIDVRDTKEALDRVEEEQNKCKKKAQQAAANTETNTGNSSQVSQNYPIVQNLQGQMVHQAISPRTLNAWVKVIEEKAFSPEVIPMFSALSEGATPADLNTMLNTVGGHQAAMQMLKETINEEAAEWDRLHPAQAGPVAPGQIREPRGSDIAGTTSTLQEQITWMTNNPPIPVGDIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSHVNSAAIMMQKGNFRNQRKTVKCFNCGKEGHLARNCRAPRKKGCWKCGREGHQMKDCTERQANFLGKIWPSHKGRPGNFLQNRTEPSAPPEEIFGFGEEAAAPPQKQEPIDKEKYPLTSLRSLFGNDPSSQ

SEQ ID NO: 78 - protein, 500 aa, Human immunodeficiency virus
MGARASVLSGGKLDKWEKIRLRPGGKKKYKLKHIVWASRELERFAVNPGLLETSEGCRQILGQLQPALQTGSEELRSLYNTVATLYCVHQRIEVKDTKEALERIEEEQNKSKKKAQQAAANTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPSSILDIRQGPKEPFRDYVDRFYKTLRAEQASQDVKNWMTETLLVQNANPDCKTILKALGPAATLEEMMTACQGVGGPGHKARVLAEAMSQVTNSGTIMMQRGNLRNQRKIVKCFNCGREGHIAKNCRAPRRRGCWKCGKEGHQMKDCTERQANFLGKIWPSYKGRPGNFLQSRPEPTAPPEESFRFGEETTTPSQKQEPIDKELYPLASLRSLFGNDPSSQ

SEQ ID NO: 79 - protein, 506 aa, Human immunodeficiency virus
MGARASVLSGGELDRWEKIRLRPGGKKKYKLKHIVWASRELERFAVNPGLLETSGGCRQILGQLQPSLQTGSEELRSLYNTVATLYCVHQKIDVKDTKEALEKIEEEQNKSKKKAQQAAADTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPSSILDIKQGPKEPFRDYVDRFYKTLRAEQASQEVKNWMTETLLVQNSNPDCKTILKALGPAATLEEMMTACQGVGGPAHKARVLAEAMSQVTNSATIMMQKGNFRNQRKAVKCFNCGKEGHIAKNCRAPRKKGCWKCGREGHQMKDCTERQANFLGKIWPSHKGRPGNFLQSRPEPTAPSAPPAESFRFGEEITTPPQKQETLIDLDKELYPSASLKSLFGNDPLLK

SEQ ID NO: 80 - protein, 503 aa, Human immunodeficiency virus
MGARASVLSGGELDRWEKIRLRPGGKKKYRLKHIVWASRELERFAVNPGLLETSEGCRQILGQLQPSLQTGSEELRSLFNTVATLYCVHQRIDVKDTKEALEKIEEEQNKSKEKAQQAAAAADTGNSKQVVSQNYPIVQNVQGQMVHQPLSPRTLNAWVKVVEERAFSPEVIPMFTALSEGATPQDLNTMLNTIGGHQAAMQMLKETINEEAAEWDRLHPVHAGPIAPGQMREPRGSDIAGTTSNLQEQIAWMTNNPPIPVGEIYKRWIILGLNKIVRMYSPTSILDIRQGPKEPFRDYVDRFYKTLRAEQASQEVKNWMTETLLVQNANPDCKHILKALGPAATLEEMMTACQGVGGPSHKARVLAEAMSQVTSSTTIMMQRGNFKNQRKIVKCFNCGKEGHIARNCRAPRKRGCWKCGKEGHQMKDCTERQANFLGKIWPSHKGRPGNFLQNRPEPSAPPEESFRCGEETTTPSQKQETIDKDLYPLTSLRSLFGSDPSSQ

SEQ ID NO: 81 - protein, 504 aa, Human immunodeficiency virus
MGARASVLSGGELDRWEKIRLRPGGKKKYKLKHIIWASRELERFAVNPGLLETSEGCRQILGQLQPSLQTGSEEFRSLYNAIAVLYCVHQRIDVKDTKEALEKVEEEQNKSKKKVQQAAAATAAAGNSSQVSQNYPIVQNMQGQMVHQAISPRTLNAWVKVVEEKAFSPEVIPMFAALSEGATPQDLNLMLNTVGGHQAAMQMLKETINEEAADWDRLHPAQAGPVAPGQIREPRGSDIAGTTSTLQEQITWMTSNPPIQVGEIYKRWIILGLNKIVRMYSPTSILDIKQGPKEPFRDYVDRFYRTLRAEQASQEVKNWMTETLLVQNSNPDCKTILKALGPAATLEEMMTACQGVGGPGHKARVLAEAMSQLTNTTNIMMQKGNFRNQRRSIKCFNCGKEGHTAKNCRAPRKKGCWKCGKEGHQMKDCTERQANFLGKIWPSHKGRPGNFLQSRPEPSAPPEEIFRFGEETTTNPSQKQEMVDKELYPLASLKSLFGNDPSSQ

SEQ ID NO: 82 - protein, 506 aa, Human immunodeficiency virus
MGARASVLSGGKLDKWEKIRLRPGGKEKYRLKHIVWASRELERFAVNPGLLETSEGCRQILGQLQPSLQTGSEELRSLYNTVATLYCVHQGIEVGDTKEALDKIEEEQNKSKKKAQQVAAAQPAAAVTGNSNQISQNYPIVQNLQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIAWMTNNPAIPVGEIYKKWIIMGLNKIVRMYSPASILDIRQGPKEPFRDYVDRFYKTLRAEQASQEVKNWMTETLLVQNANPDCKTILKALGPAATLEEMMTACQGVGGPGHKARVLAEAMSQATNQATIMMQKGNFRNQRKTVKCFNCGKEGHIARNCRAPRKKGCWKCGKEGHQMKDCTERQVNFLGKIWPSHKGRPGNFLQSRLEPTAPPAESFRFGEETATPSQKQETIDKELYPLASLKSLFGNDPSSQ

SEQ ID NO: 83 - protein, 507 aa, Human immunodeficiency virus
MGARASVLSGGELDKWEKIRLRPGGKKKYQLKHIVWASRELERFAVNPGLLETSEGCRQIIKQLQPSLQTGSEELKSLYNTVAVLYCVHQKIEIKDTKEALEKIEEEQNKSKKKAQQAAADTGNSSQVSQNYPIVQNMQGQMVHQALSPRTLNAWVKVIEEKAFSPEVIPMFTALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPVSILDIRQGPKEPFRDYVDRFYKTLRAEQATQDVKNWMTETLLVQNANPDCKTILKALGPGASLEEMMTACQGVGGPGHKARVLAEAMSQVTTPPAIMMQRGNFRNPRKVVKCFNCGKEGHIAKNCRAPRKRGCWKCGKEGHQMKDCTERQANFLGKIWPSSKGRPGNFLQSRPEPTAPPEPTAPPAASFRFGEETTTPPQKQEPPVDRELYPLASLKSLFGNDPSSQ

SEQ ID NO: 84 - protein, 499 aa, Human immunodeficiency virus
MGARASVLSGGELDKWEKIRLRPGGKKKYQLKHIVWASRELERFAVNPGLLETSEGCRQILGQLQPSLRTGSEELKSLFNTVAVLYCVHQKIDVKDTKEALDKIEEEQNKSNKKAQQAAADTGNRSQASQNYPIVQNLQGQMVHQPISPRTLNAWVKVIEEKAFSPEVIPMFTALSEGATPQDLNTMLNTVGGHQAAMQMLKETINEEAAEWDRLHPVQAGPIAPGQIREPRGSDIAGTTSNLQEQITWMTSNPPIPVGEIYKRWIILGLNKIVRMYSPVSILDIRQGPKEPFRDYVDRFYKTLRAEQATQEVKNWMTETLLVQNANPDCKNILKALGPAATLEEMMTACQGVGGPSHKARVLAEAMSQAQTSTAMMMQGSNHRNQRKIVKCFNCGKVGHIARNCRAPRKKGCWKCGREGHQMKDCTERQANFLGKIWPSHKGRPGNFLQSRPEPTAPPEESFRFGEETTNPPQKQEPIDELYPMASLKSLFGNDPSSQ

SEQ ID NO: 85 - protein, 500 aa, Human immunodeficiency virus
MGARASVLSGGQLDKWERIRLRPGGKKKYQLKHIVWASRELERFAVNPGLLETSEGCRQILRQLQPSLQTGSEELKSLYNTVATLYCVHQKIDVKDTKEALEKIEEEQNKSKKKAQQAAADTGNSSQVSQNYPIVQNMQGQMVHQAISPRTLNAWVKVIEEKAFSPEIIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPVSILDIRQGPKESFRDYVDRFYKTLRAEQASQDVKNWMTETLLVQNANPDCKTILKALGPGATLEEMMTACQGVGGPSHKARVLAEAMSQMTPPPTVMMQRGNFRGQRKVVKCFNCGKEGHIAKNCRAPRKRGCWKCGKEGHQMKDCTERQANFLGKIWPSYKGRPGNFLQSRPEPTAPPEESFKFGGETTTPPQKQETVDKDLYPLASLRSLFGNDPSSQ

SEQ ID NO: 86 - protein, 502 aa, Human immunodeficiency virus
MGARASVLSGGELDRWEKIRLRPGGKKQYKLKHIVWASRELERFAVNPGLLETSEGCKQILEQLQPALRTGSEEFRSLYNTIAVLYCVHQRIGVKDTKEALDKIEEEQNKSKKKAQQVAADTENKSQVSQNYPIVQNIQGQMVHQPISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNSATIMMQKGNFRNQRKSVKCFNCGKEGHIARNCRAPRKKGCWKCGREGHQMKDCTERQANFLGKIWPSHKGRPGNFPQSRTEPTAPPEESFRFGEETTTPSQKQGQGPIDKELYPLTSLRSLFGNDPSSQ

SEQ ID NO: 87 - protein, 500 aa, Human immunodeficiency virus
MGARASVLSGGQLDRWEKIRLRPGGKKKYKLKHLVWASRELERFAVNPGLLETSEGCRQILGQLQPALQTGSEEFRSLYNTIATLYCVHQQIEVKDTKEALDKIEEEQNKSKKKAQQTAAGTGNSSQVSQNYPIVQNIQGQMVHQPISPRTLNAWVKVVEEKAFSPEVIPMFSALSEGATPQDLNTMLNTMGGHQAAMQMLKETINEEAADWDRLHPVQAGPVAPGQMREPRGSDIAGTTSALQEQIGWMTSNPPIPVGEIYKRWIILGLNKIVRMYSPTSILDIRQGPKEPFRDYVDRFYKTLRAEQASQEVKNWMTETLLVQNANPDCRTILKALGPAATLEEMMTACQGVGGPGHKARVLAEAMSQATNSATIMMQKGNFRNQRKTVKCFNCGKDGHIAKNCRAPRKKGCWKCGKEGHQMKDCTERQANFLGKSWPSHKGRPGNFLQSRPTPSAPPEESFRFGEETATPSQRPESIDKEMYPLTSLRSLFGNDPSSQ

SEQ ID NO: 88 - protein, 497 aa, Human immunodeficiency virus
MGARASVLSGGELDKWEKIRLRPGGKKQYKLKHIVWASRELERFAVNPGLLETSEGCRQILRQLQPSLQTGSEELKSLFNTVATLYCVHQRIEVKDTKEALDKIEEEQNKSKKKAQTAAADTGNNSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLIQNANPDCKTILKALGPGATLEEMMTACQGVGGPGHKARVLAEAMSQVTNSTAIMMQRGNFRNQRKNIKCFNCGKEGHIAKNCRAPRKKGCWKCGKEGHQMKDCTERQANFLGKIWPSHKGRPGNFLQSRPEPTAPPEESFRFGEETTTPSQKQEPKDKELYPLASLKSLFGNDP

SEQ ID NO: 89 - protein, 507 aa, Human immunodeficiency virus
MGARASVLSGGKLDQWEKIRLRPGGRKKYKLKHIVWASRELERFAVNPGLLETSEGCRQILEQLQPALKTGSEELKSLYNTVATLYCVHQRIDVKDTKEALDRIEEEQNKSKKAAQPAAAAAAAGNSSQVSQNYPIVQNLQGQMVHQAISPRTLNAWVKVVEEKAFNPEVIPMFAALSEGATPQDLNTMLNTVGGHQAAMQMLKETINDEAAEWDRTHPVHAGPIAPGQMREPRGSDIAGTTSTLQEQIAWMTNNPPIPVGEIYKKWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNSTAIMMQRGNYKGQRKAVKCFNCGKEGHIARNCRAPRKKGCWKCGKEGHQMKDCTERQANFLGKIWPSHKGRPGNFLQNRPEPTAPVEPTAPPEESFRFGEGTTPSLKQEPTDKELYPLTSLKSLFGNDPSSQ

SEQ ID NO: 90 - protein, 498 aa, Human immunodeficiency virus
  variant (127)..(127): Xaa can be any naturally occurring amino acid
  variant (413)..(413): Xaa can be any naturally occurring amino acid
MGARASVLSGGELDRWEKIRLRPGGKKKYRLKHIVWASRELERFALNPGLLETSEGCRQILGQLQPALQTGSEEIKSLYNTVATLYCVHQKKEVRDTKEALDKIEEEQNKSKKKAQQAAAGTGNSSXTSQNYPIVQNLQGQMVHQSLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPVNIMMQKGNFRNQRKTIKCFNCGKEGHLARNCRAPRKRGXWKCGKEGHQMKDCTENQANFLGKIWPSHKGRPGNFLQSRPEPTAPPEESFRFGEETATPSQKQESIDKYPLTSLRSLFGNDPSSQ

SEQ ID NO: 91 - protein, 500 aa, Human immunodeficiency virus
MGARASVLSGGELDRWEKIRLRPGGRKKYKLKHIVWASRELERFAVNPGLLETSEGCRQILEQLQPSLQTGSEELKSLFNTVATLYCVHQKIDVKDTKEALEKIEEEQNKSKKRAQQAAADTKNNSQVSQNYPIVQNLQGQMVHQAISPRTLNAWVKVVEEKAFSPEVIPMFSALSEGATPQDLNTMLNTVGGHQAAMQMLKETINEEAAEWDRLHPVQAGPVAPGQMRDPRGSDIAGTTSTLQEQVGWMTSNPPIPVGEIYKRWIILGLNKIVRMYSPTSILDIKQGPKEPFRDYVDRFYKILRAEQASQEVKNWMTETLLVQNANPDCKTILKALGPAATLEEMMTACQGVGGPGHKARVLAEAMSQVTNSASIMMQRGNFRNQKRPVKCFNCGKEGHIAKNCRAPRKKGCWKCGKEGHQMKDCTERQANFLGKIWPSHKGRPGNFLQSRPEPTAPPEESFRFGEETAAPSQKQEPIDKETYPLASLRSLFGNDPSSQ

SEQ ID NO: 92 - protein, 500 aa, Human immunodeficiency virus
MGARASVLSGGQLDRWEKIRLRPGGKKQYKLKHIVWASRELERFAVNPGLLETSEGCRQILGQLQPSLQTGSEELKSLFNTIAVLYCVHQRIEVKDTKEALDKIEEEQNKSKKKAQQAAADTEKSSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIIMGLHKIVRMYSPTSILDIRQGPKEPFRDYVDRFYKTLRAEQASQEVKNWMTETLLVQNANPDCKTILKALGPAATLEEMMTACQGVGGPGHKARVLAEAMSHVTNSATIMMQKGNFKNQRKTVKCFNCGKEGHIARNCRAPRKRGCWKCGKEGHQMKDCNERQANFLGKIWPSHKGRPGNFLQSRPEPTAPPEESFRFGEETATPPQKQEPRDKELYPLASLKSLFGNDPSSQ

SEQ ID NO: 93 - protein, 500 aa, Human immunodeficiency virus
  variant (28)..(28): Xaa can be any naturally occurring amino acid
  variant (46)..(46): Xaa can be any naturally occurring amino acid
  variant (84)..(84): Xaa can be any naturally occurring amino acid
  variant (88)..(88): Xaa can be any naturally occurring amino acid
  variant (94)..(94): Xaa can be any naturally occurring amino acid
  variant (138)..(138): Xaa can be any naturally occurring amino acid
  variant (215)..(215): Xaa can be any naturally occurring amino acid
  variant (243)..(243): Xaa can be any naturally occurring amino acid
  variant (306)..(306): Xaa can be any naturally occurring amino acid
  variant (337)..(337): Xaa can be any naturally occurring amino acid
  variant (394)..(394): Xaa can be any naturally occurring amino acid
  variant (421)..(421): Xaa can be any naturally occurring amino acid
  variant (426)..(426): Xaa can be any naturally occurring amino acid
  variant (478)..(478): Xaa can be any naturally occurring amino acid
MGARASVLSGGELDRWEKIRLRPGGKKXYKLKHIVWASRELERFAXNPGLLETSKGCRQILEQLQPSLQTGSEELKSLYNTIAXLYCXHQRIEXKDTKEALDKIEEEQNKSKKMAQQAAADTGNNKQVSQNYPIVQNXQGQMVHQAISPRTLNAWVKVIEEKAFSPEVIPMFSALSEGATPGDLNTMLNTVGGHQAAMQMLKETINEEAAEWDRXHPVHAGPVAPGQMREPRGSDIAGTTSTXQEQIAWMTANPPIPVGDIYKRWIILGLNKIVRMYSPTSILDIKQGPKEPFRDYVDRFYKTLRXEQASQEVKNWMTETLLVQNANPDCKTILKAXGPAATLEEMMTACQGVGGPGHKARVLAEAMSQVTNSATIMMQRGNFRNQRKTVKCFXCGKEGHIAKNCRAPRKKGCWKCGREGXQMKDXTERQANFLGKIWPSHKGRPGNFLQSRPEPTAPPEESFRCGEETTTPSQKQEXIDKEMYPLASLRSLFGNDPSSQ

SEQ ID NO: 94 - protein, 500 aa, Human immunodeficiency virus
MGARASVLSGGELDRWEKIRLRPGGKKKYKLKHIVWASRELERFAVNPGLLETSEGCRQILGQLQPALQTGSEELKSLYNTVAVLYCVHQKIEVKDTKEALEKIEEEQNKSKKKAQQAAANTGNGSPVSQNYPIVQNIQGQMVHQAISPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPASILDIRQGPKEPFRDYVDRFYKTLRAEQASQEVKNWMTETLLVQNANPDCKTILKALGPGATLEEMMTACQGVGGPGHKARVLAEAMSQVTNSATIMVQRGNFRNQRKTVKCFNCGKEGHIAKNCRAPRKKGCWKCGREGHQMKDCTERQANFLGKIWPSHKGRPGNFLQSRPEPTAPPEESFRFGEETTTPSQKQGTIDKELYPLASLRSLFGNDPSSQ

SEQ ID NO: 95 - protein, 500 aa, Human immunodeficiency virus
  variant (106)..(106): Xaa can be any naturally occurring amino acid
  variant (113)..(113): Xaa can be any naturally occurring amino acid
  variant (120)..(120): Xaa can be any naturally occurring amino acid
  variant (124)..(124): Xaa can be any naturally occurring amino acid
  variant (175)..(175): Xaa can be any naturally occurring amino acid
  variant (185)..(185): Xaa can be any naturally occurring amino acid
  variant (202)..(202): Xaa can be any naturally occurring amino acid
  variant (213)..(213): Xaa can be any naturally occurring amino acid
  variant (250)..(250): Xaa can be any naturally occurring amino acid
  variant (263)..(263): Xaa can be any naturally occurring amino acid
  variant (266)..(266): Xaa can be any naturally occurring amino acid
  variant (273)..(273): Xaa can be any naturally occurring amino acid
  variant (282)..(282): Xaa can be any naturally occurring amino acid
  variant (377)..(377): Xaa can be any naturally occurring amino acid
  variant (391)..(391): Xaa can be any naturally occurring amino acid
  variant (481)..(481): Xaa can be any naturally occurring amino acid
MGARASVLSGGKLDKWEKIRLRPGGKKKYKLKHIVWASRELERFAVNPGLLETAEGCRQILGQLQPSLQTGSEELKSLFNTVATLYCVHQNIDIKDTKEALDKVEXEQNQSKXKAQQAAXAADXRNSCQVSQNYPIVQNLQGQMVHQALSPRTLNAWVKVVEEKAFSPEVIPMFXALSEGATPQXLNTMLNTVGGHQAAMQXLKETINEEAAXWDRLHPVQAGPVAPGQLREPRGSDIAGTTSTLQEQIXWMTHNPPIPVGEXYKXWIIMGLXKIVRMYSPXSILDIRQGPKEPFRDYVDRFYKTLRAEQASQEVKNWMTETLLVQNANPDCKTILKALGPGATLEDMMTACQGVGGPGHKARVLAEAMSQVTNSAXVMMQKGNFRNQRKXVKCFNCGKEGHIARNCRAPRKKGCWKCGKEGHQMKDCTERQANFLGKIWPSHKGRPGNFPQSRLEPTAPPEESFRFGEETTTPPQKQGSXDKNPLTSLRSLFGNDPSSQ

SEQ ID NO: 96 - protein, 500 aa, Human immunodeficiency virus
  variant (12)..(12): Xaa can be any naturally occurring amino acid
  variant (40)..(40): Xaa can be any naturally occurring amino acid
  variant (65)..(65): Xaa can be any naturally occurring amino acid
  variant (118)..(118): Xaa can be any naturally occurring amino acid
  variant (138)..(138): Xaa can be any naturally occurring amino acid
  variant (188)..(188): Xaa can be any naturally occurring amino acid
  variant (226)..(226): Xaa can be any naturally occurring amino acid
  variant (270)..(270): Xaa can be any naturally occurring amino acid
  variant (319)..(319): Xaa can be any naturally occurring amino acid
  variant (376)..(376): Xaa can be any naturally occurring amino acid
  variant (443)..(443): Xaa can be any naturally occurring amino acid
  variant (446)..(446): Xaa can be any naturally occurring amino acid
  variant (469)..(469): Xaa can be any naturally occurring amino acid
  variant (473)..(473): Xaa can be any naturally occurring amino acid
  variant (477)..(477): Xaa can be any naturally occurring amino acid
  variant (486)..(486): Xaa can be any naturally occurring amino acid
MGARASVLSGGXLDRWEKIRLRPGGKKKYKLKHIVWASRXLERFAVNPGLLETSEGCRQILGQLXPSLQTGSEELKSLFNTVATLYCVHQRIEVKDTKEALEKIEEEQNKSKEKARQXAADTGNKSQVSQNYPIVQNXQGQMVHQAISPRTLNAWVKVVEEKAFSPEVIPMFSALSEGATPQDLNTMXNTVGGHQAAMQILKETINEEAAEWDRLHPVHAGPIAPXQMREPRGSDIAGTTSTLQEQIGWMTHNPPIPVGDIYKRWIILGXNKIVRMYSPTSILDIRQGPKEPFRDYVDRFYKTLRAEQASQDVKNWMTXTLLVQNSNPDCKTILKALGPAATLEEMMTACQGVGGPGHKARVLAEAMSQVTNSATXMMQKSNFRNQRKVVKCFNCGKEGHIARNCRAPRKKGCWKCGKEGHQMKDCTERQANFLGKIWPSHKXRPXNFLQSRPEPTAPPEESFRFGEEXTTPXQKQXPIDKELYPXTSLKSLFGNDPSLQ

SEQ ID NO: 97 - protein, 497 aa, Human immunodeficiency virus
MGARASILSGGQLDRWEKIRLRPGGKKKYRLKHIVWASRELERFAVNPGLLETSEGCRKILEQLQPSLQTGSEELKSLFNTVATLYCVHQKIDVRDTKEALDKIEEEQNKCKKKAQQVTADTGNSSQVSQNYPIVQNIQGQMVHQALSPRTLNAWVKVVEEKAFSPEVIPMFTALSEGATPQDLNTMLNTVGGHQAAMQMLKETINEEAAEWDRVHPVHAGPIAPGQIREPRGSDIAGTTSTLQEQITWMTNNPPIPVGEIYKRWIILGLNKIVRMYSPTSILDIKQGPKEPFRDYVDRFYKTLRAEQASQDVKNWMTETLLVQNANPDCKTILKALGPGASLEEMMTACQGVGGPTHKARILAEAMSQATGANTIMMQRGNFRNQRKPVKCFNCGKEGHIAKNCRAPRKKGCWKCGQEGHQMKDCTERQANFLGKIWPSHKGRPGNFLQSRPEPTAPPEESFREEITPPQKQEPRDKEMYPLVSLKSLFGNDPSSQ

SEQ ID NO: 98 - protein, 501 aa, Human immunodeficiency virus
MGARASVLSGGELDRWEKIRLRPGGKKTYKLKHIVWASRELERFAVNPGLLETSVGCRQILGQLQPSLQTGSEELKSLYNTVATLYCVHQKIEIRDTKEALDKIEEEQNKSKKKAQQAAADTGNSSQVSHNYPIVQNLQGQMVHQPLSPRTLNAWVKVVEEKAFSPEVIPMFTALSEGATPQDLNTMLNTVGGHQAAMQMLKETINEEAAEWDRLHPVHAGPVAPGQMREPRGSDIAGTTSNLQEQIAWMTSNPPIPVGEIYKRWIILGLNKIVRMYSPTSILDIRQGPKEPFRDYVDRFYKTLRAEQASQDVKNWMTETLLVQNANPDCKTILKALGPAATLEDMMTACQGVGGPGHKARVLAEAMSQVTNSSATIMMQGGKFRNQRKIVKCFNCGKEGHIARNCRAPRKRGCWKCGQEGHQMKDCTERQANFLGKIWPSCKGRPGNFLQSRPEPSAPPEESFRFGEETTTPSQKQESIDKERYPLTSLRSLFGNDPLSQ

SEQ ID NO: 99 - protein, 505 aa, Human immunodeficiency virus
  variant (233)..(233): Xaa can be any naturally occurring amino acid
  variant (362)..(362): Xaa can be any naturally occurring amino acid
MGARASVLSGGQLDKWEKIRLRPGGKKKYQLKHIVWASRELERFAVNPGLLETSEGCRQILKQLQPSLQTGSEELKSLFNTVATLYCVHQRIDVKDTKEALDKIEEEQNKSKKKAQPAAADTGNSGQVSQNFPIVQNLQGQMVHQPLSPRTLNAWVKVVEEKAFSPEVIPMFSALSEGATPQDLNTMLNTVGGHQAAMQMLKETINEEAAEWDRLHPVHAGPIAPGQMREPRXSDIAGTTSTLQEQIGWMTHNPPIPVGEIYKRWIILGLNKIVRMYSPTSILDIRQGPKEPFRDYVDRFYKTLRAEQATQEVKNWMTETLLVQNANPDCKTILKALGPGATLEEMMTACQGVGGPGHKARXLAEAMSQVTNSATVMMQRGNFRNQRRIVKCFNCGKEGHIAKNCRAPRKKGCWKCGKEGHQMKDCTNERQANFLGKIWPSHKGRPGNFLQNRPEPRPEPTAPPEESFRFGEETATPPQKQEPTDKELYPLASLRSLFGNDHSSQ

SEQ ID NO: 100 - protein, 502 aa, Human immunodeficiency virus
  variant (26)..(26): Xaa can be any naturally occurring amino acid
  variant (375)..(375): Xaa can be any naturally occurring amino acid
  variant (391)..(391): Xaa can be any naturally occurring amino acid
MGARASVLSGGELDRWEKIRLRPGGXKKYQLKHIVWASRELERFAVNPGLLETSEGCRQILGQLQPALQTGSEELKSLFNTVAVLYCVHQKIEVKDTKEALDKIEEEQTKSKKKAQQAAAAADTGSSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVTNXATVMMQRGNLRNQRKXVKCFNCGKEGHIAKNCRAPRRKGCWKCGKEGHQMKDCTERQANFLGKIWPSHKGRPGNFLQSRPEPTAPPEESFRFGEETTTPSQKQETIDKERYPLTSLRSLFGNDPSSQ

SEQ ID NO: 101 - protein, 500 aa, Human immunodeficiency virus
  variant (31)..(31): Xaa can be any naturally occurring amino acid
  variant (46)..(46): Xaa can be any naturally occurring amino acid
  variant (51)..(51): Xaa can be any naturally occurring amino acid
  variant (55)..(55): Xaa can be any naturally occurring amino acid
  variant (111)..(111): Xaa can be any naturally occurring amino acid
  variant (114)..(114): Xaa can be any naturally occurring amino acid
  variant (137)..(137): Xaa can be any naturally occurring amino acid
  variant (197)..(197): Xaa can be any naturally occurring amino acid
  variant (261)..(261): Xaa can be any naturally occurring amino acid
  variant (283)..(283): Xaa can be any naturally occurring amino acid
  variant (290)..(290): Xaa can be any naturally occurring amino acid
  variant (295)..(295): Xaa can be any naturally occurring amino acid
  variant (312)..(312): Xaa can be any naturally occurring amino acid
  variant (329)..(329): Xaa can be any naturally occurring amino acid
  variant (358)..(358): Xaa can be any naturally occurring amino acid
  variant (415)..(415): Xaa can be any naturally occurring amino acid
  variant (422)..(422): Xaa can be any naturally occurring amino acid
  variant (425)..(425): Xaa can be any naturally occurring amino acid
  variant (446)..(446): Xaa can be any naturally occurring amino acid
  variant (470)..(470): Xaa can be any naturally occurring amino acid
  variant (472)..(472): Xaa can be any naturally occurring amino acid
MGARASVLSGGELDRWEKIRLRPGGKKKYRXKHIVWASRELERFAXNPGLXETSXGCRQIIRQLQPSLQTGSEELRSLYNTVATLYCVHQKIEVKDTKEALEKIEEEQNKXKKXAQPAAADTGSTSQVSQNYPIVQXMQGQMVHQAISPRTLNAWVKVVEEKAFSPEVIPMFSALSEGATPQDLNTMLNTVGGHQAXMQMLKETINEEAAEWDRLHPVHAGPIAPGQMREPRGSDIAGTTSTLQEQIGWMTHNPPIPVGEXYKRWIILGLNKIVRMYSPTSIXDIRQGPXEPFRXYVDRFYKTLRAEQASQXVKNWMTETLLVQNANPXCKTILKALGPAATLEEMMTACQGVGGPGXKARILAEAMSQVTNPATIMMQRGNFRNQRKIVKCFNCGKEGHIAKNCRAPRKRGCWXCGKEGHXMKXCTERQANFLGKIWPSHKGRPXNFLQSRPEPTAPPEESFRFGEETXTXPQKQEPTDKELYPLASLRSLFGNDPSSQ

SEQ ID NO: 102 - protein, 508 aa, Human immunodeficiency virus
  variant (41)..(41): Xaa can be any naturally occurring amino acid
  variant (117)..(117): Xaa can be any naturally occurring amino acid
  variant (122)..(122): Xaa can be any naturally occurring amino acid
  variant (242)..(242): Xaa can be any naturally occurring amino acid
  variant (491)..(491): Xaa can be any naturally occurring amino acid
  variant (495)..(495): Xaa can be any naturally occurring amino acid
  variant (506)..(506): Xaa can be any naturally occurring amino acid
MGARASILTGGELDRWEKIRLRPGGKKKYRLKHVVWASREXERFAVNPGLLETSEGCRQILGQLQPALQTGSEELRSLYNTVAVLFCVHQKIEVKDTKEALEKIEEEQNKSKNKAQXAAAAXADTGNGSKVSQNYPIVQNMQGQMVHQPISPRTLNAWVKVVEEKAFSPEVIPMFSALSEGATPQDLNTMLNTVGGHQAAMQMLKETINEEAADWDRLHPVHAGPVAPGQMREPRGSDIAGXTSTLQEQIGWMTHNPPIPVGEIYKRWIILGLNKIVRMYSPTSILDIKQGPKEPFRDYVDRFYKILRAEQASQEVKNWMTETLLVQNANPDCKTILKALGPAATLEEMMTACQGVGGPGHKARVLAEAMSQVTTASAAIMMQKGNFRTPRKTVKCFNCGKEGHIARNCRAPRKRGCWKCGKEGHQMKDCTERQANFLGKIWPSHKGRPGNFLQSRPEPTAPPEESFRFREEATTPSQKQEPIDKEIDKEXYPLXSLRSLFGNDPXSQ

SEQ ID NO: 103 - protein, 508 aa, Human immunodeficiency virus
MGARASVLSAGELDKWEKIRLRPGGKKKYRLKHIVWASRELERFAVNPGLLETSVGCRQILGQLQPSLQTGSEELRSLYNTVATLYCVHQKIEVRDTKEALEKVEEEQNKCKKKAQQAAAAADTGNSSQVSQNYPIVQNLQGQMVHQPISARTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIAWMTNNPPVPVGEIYKRWIILGLNKIVRMYSPTSILDIRQGPKEPFRDYVDRFYKTLRAEQASQDVKNWMTETLLVQNANPDCKTILKALGPGASLEEMMTACQGVGGPSHKARVLAEAMSQATNSTAVMMQRGNFKNQRKIIKCFNCGKEGHIARNCRAPRKRGCWKCGKEGHQMKDCTERQANFLGKIWPSHKGRPGNFLQSRPEPSAPAEPSAPPAESFRFGEETATPSQKQEQIDKEMYPLASLRSLFGNDPSSQ

SEQ ID NO: 104 - protein, 504 aa, Human immunodeficiency virus
MGARASVLSGGDLDRWEKIRLRPGGKKKYKLKHIVWASRELERFAVNPGLLETSAGCRQILGQLQPSLQTGSEELKSLFNTVAVLYCVHQKIDVKDTKEALDKIEEEQNKSKKKVQQAAADTGNNSQVSQNYPIVQNLQGQMVHQAISPRTLNAWVKVIEEKAFSPEVIPMFTALSEGATPQDINTMLNTVGGHQAAMQMLKETINEEAAEWDRLHPVQAGPVAPGQMRDPRGSDIAGTTSTLQEQIAWMTSNPPIPVGEIYKKWIIMGLNKIVRMYSPTSILDIKQGPKEPFRDYVDRFYKTLRAEQATQEVKNWMTETLLVQNANPDCKTILKALGTGATLEEMMTACQGVGGPAHKARVLAEAMSQLTPATVMMQKGNFRNSRKSVKCFNCGREGHIAKNCRAPRKKGCWKCGKEGHQMKDCTERQANFLGKIWPSNKGRPGNFLQNRPEPTAPEPTAPPLESFRFGEEATAPPQRQEPIDRELYPSASLKSLFGNDPSSQ

SEQ ID NO: 105 - protein, 500 aa, Human immunodeficiency virus
MGARASVLSGGELDRWERIRLRPGGKKKYRLKHIVWASRELERFALNPGLLETSDGCRQILGQLQPSLQTGSEELRSLYNTVAVLFCVHQKIEVKDTKEAVEKIEEEQNKSKKKAQPAAADTGNSSQVSRNYPIVQNIQGQMVHQPISPRTLNAWVKVVEEKAFSPEVIPMFAALSEGATPQDLNTMLNTVGGHQAAMQMLKETINEEAAEWDRMHPVHAGPVAPGQMREPRESDIAGTTSTLQEQIGWMTNNPPIPVGEIYKKWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNSRKTVKCFNCGKEGHIAKNCRAPRKKGCWKCGKEGHQMKDCTERQANFLGKIWPSHKGRPGNFLQSRPEPTAPPEESFRFGEEITTPPQKQEPVDKEMYPLTSLKSLFGNDPSSQ

SEQ ID NO: 106 - protein, 503 aa, Human immunodeficiency virus
MGARASVLSGGELDKWEKIRLRPGGKKKYQLKHIVWASRELERFALNPGLLESAEGCRQILGQLHPSLKTGSEELKSLYNTIATLYCVHQKIDVKDTKEALDKIEEEQNKCKKKAQQAAAADTNSPVSQNYPIVQNLQGQMVHQAISPRTLNAWVKVIEEKAFSPEVIPMFSALSEGATPQDLNTMLNTVGGHQAAMQMLKETINEEAAEWDRTHPVQAGPVAPGQVREPRGSDIAGTTSTLQEQIAWMTHNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSTAIMMQRGNFKGQRKNVKCFNCGKEGHIARNCRAPRKKGCWKCGREGHQMKDCTERQANFLGKIWPSQRGRPGNFLQSRPESRPEPTAPPAESFRFGEETTTPSQKQEPIDKEMYPLASLRSLFGNDPSSQ

SEQ ID NO: 107 - protein, 507 aa, Human immunodeficiency virus
MGARASVLSGGELDKWEKIRLRPGGKKTYKLKHIVWASRELERFAVNPGLLETAEGCRQILGQLQPSLQTGSEELKSLFNAIAVLYCVHQRIDVKDTKEALDKIEEEQNKSKKKTQQAAAGTGNSTGNSSQVSQNYPIVQNMQGQMVHQAMSPRTLNAWVKVIEEKAFSPEVIPMFAALSEGATPQDLNTMLNTVGGHQAAMQMLKETINEEAAEWDRIHPVHAGPVAPGQMRKPRGSDIAGTTSTLQEQIGWMTSNPPVPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTSSATIMMQRGNFRNQRKTVKCFNCGREGHIARNCRAPRKKGCWKCGQEGHQMKDCTERQANFLGKIWPSHKGRPGNFLQSRPEPTVPTAPLEESFRFGEGTTTPPQKQDTIDKELYPSASLRSLFGNDPLLQ

SEQ ID NO: 108 - protein, 501 aa, Human immunodeficiency virus
MGARASVLSGGELDRWEKIWLRPGGKKKYRLKHIVWASRELERFAVNPGLLETSEGCRQILGQLQPSLQTGSEELKSLYNTVAVLYCVHQKIEIKDTKEALDKIAEEQNKCKKKTQQAAADTGNSSSQVSQNYPIVQNSQGQMVHQALSPRTLNAWVKVVEEKAFSPEVIPMFSALSEGATPHDLNTMLNTVGGHQAAMQMLKETINEEAAEWDRLHPVHAGPVAPGQMREPRGSDIAGTTSNLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVTSPATIMMQRGNFKGQRKMVKCFNCGKEGHIARNCRAPRKKGCWKCGKEGHQIKDCTERQANFLGKIWPSHKGRPGNFLQSRPEPTAPPEESLRFREETTTPSQKQETTDKELYPLASLKSLFGNDPLSQ

SEQ ID NO: 109 - protein, 499 aa, Human immunodeficiency virus
  variant (39)..(39): Xaa can be any naturally occurring amino acid
  variant (120)..(120): Xaa can be any naturally occurring amino acid
  variant (129)..(129): Xaa can be any naturally occurring amino acid
  variant (145)..(145): Xaa can be any naturally occurring amino acid
  variant (180)..(180): Xaa can be any naturally occurring amino acid
  variant (201)..(201): Xaa can be any naturally occurring amino acid
  variant (203)..(203): Xaa can be any naturally occurring amino acid
  variant (261)..(261): Xaa can be any naturally occurring amino acid
  variant (271)..(271): Xaa can be any naturally occurring amino acid
  variant (306)..(306): Xaa can be any naturally occurring amino acid
  variant (312)..(312): Xaa can be any naturally occurring amino acid
  variant (331)..(331): Xaa can be any naturally occurring amino acid
  variant (481)..(482): Xaa can be any naturally occurring amino acid
MGARASVLSGGALDKWEKIRLRPGGKKKYKLKHIVWASXELERFAVNPGLLETSEGCRQILVQLQPSLQTGSEELKSLYNTVAVLYCVHQRIDIKDTKEALEKIEEEQNKSKKKAQQAAXDTGNSSQVXQNYPIVQNLQGQMVHXPISPRTLNAWVKVVEEKAFSPEVIPMFSALAEGAXPQDLNTMLNTVGGHQAAMQMXKXTINEEAAEWDRLHPVHAGPIAPGQMREPRGSDIAGTTSNLQEQIGWMTNNPPIPVGEXYKRWIILGLXKIVRMYSPTSILDIRQGPKEPFRDYVDRFYKTLRXEQASQXVKNWMTETLLVQNANPDCXTILKALGPAATLEEMMTACQGVGGPGHKARVLAEAMSQVTNSATVMMQRGNFKNQGKIVKCFNCGKVGHIARNCRAPRKKGCWKCGKEGHQMKDCDKQANFLGKIWPSHKERPGNFLQSRPEPTAPPAESFRFGEETTTPSQKQEPIDKXXYPMASLRSLFGNDPSSQ

SEQ ID NO: 110 - protein, 502 aa, Human immunodeficiency virus
  variant (408)..(408): Xaa can be any naturally occurring amino acid
MGARASVLSGGDLDRWEKIRLRPGGKKQYKLKHIVWASRELERFAVNPGLLETAEGCKQILGQLQPALQTGSEEFRSLYNTVATLYCVHQKIDIRDTKEALDKIEEEQDKCKKKAQQAAANTGNSGQVSQNYPIVQNLQGQMVHQAISPRTLNAWVKVIEEKAFSPEVIPMFSALSEGATPQDLNTMLNTVGGHQAAMQMLKETINEEAAEWDRLHPVPAGPVAPGQMREPRGSDIAGTTSTLQEQIGWMTSNPAIPVGEIYKRWIILGLNKIVRMYSPVSILDIRQGPKEPFRDYVDRFYKVLRAEQASQDVKNWMTETLLVQNANPDCKTILKALGPAATLEEMMTACQGVGGPGHKARVLAEAMSQATNINAAAMMMQRGNFNGPRKTIKCFNCGKIGHLAKNCXAPRKKGCWKCGKEGHQMKDCNERQANFLGKIWPSNKGRPGNFLQSRPEPTAPPEESFRFGEEVATPSQKQEPRDKELYPLTSLRSLFGNDPSSQ

SEQ ID NO: 111 - protein, 505 aa, Human immunodeficiency virus
MGARASVLSGGELDKWEKIRLRPGGKKKYQLKHIVWASRELERFAVNPGLLETSGGCRQILEQLQPSLQTGSEELKSLFNTVATLYCVHQKIDIRDTKEALEKIEEEQNKSKKKAQQAAANTGNGNQASQVSQNYPIVQNLQGQMVHQPISPRTLNAWVKVVEEKAFSPEVIPMFAALSEGATPQDLNTMLNTVGGHQAAMQMLKETINEEAAEWDRMHPVHAGPVAPGQMREPRGSDIAGTTSTLQEQIGWMTSNPAIPVGEIYKKWIIMGLNKIVRMYSPTSILDIKQGPKESFRDYVDRFYKVLRAEQASQDVKNWMTETLLVQNANPDCKTILKALGPAATLEEMMTACQGVGGPGHKARVLAEAMCQVTGSATAAIMMQKGNFKTQRKIVKCFNCGREGHIAKNCRAPRKKGCWKCGKEGHQMKDCTERQANFLGKIWPSYKGRPGNFLQNRPEPSAPPEESFRFGEETATPSQKQEPTDKELYPLASLKSLFGNDPSSQ

SEQ ID NO: 112 - protein, 505 aa, Human immunodeficiency virus
MGARASVLSGGELDRWEKIRLRPGGKKQYKLKHIVWASRELERFAINPGLLETSEGCRQILGSLQPSLQTGSEELKSLYNTVATLYCVHQGINIKDTKEALDKVEEEQNKSKKKAQPAAADTGNTSQVSQNYPIVQNLQGQMVHQAISPRTLNAWVKVVEEKAFSPEVIPMFSALAEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQASGLASAAIMMQRGNFRNQRKIVKCFNCGKEGHIAKNCRAPRKKGCWKCGKDGHQMKDCTERQANFLGKIWPSHKGRPGNFFQSRPEPTAPPAPPEESFRFGEEATTPPQKQERKDKELYPLASLKSLFGNDPSSQ

SEQ ID NO: 113 - protein, 502 aa, Human immunodeficiency virus
MGARASILSGGELDRWEKIRLRPGGKKKYKLKHIVWASRELERFAVNPGLLETSEGCRQILGQLQPSLQTGSEELKSVYNTVATLYCVHQKIEVKDTKEALDKIEEEQNKSKKRAQQAAAAADSGTNSNVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKILRAEQCSQDVKNWMTETLLVQNANPDCKTILKALGPAATLEEMMTACQGVGGPGHKARVLAEAMSQMTNSTAIMMQRGNFRNQRRSVKCFNCGKEGHIAKNCRAPRKKGCWKCGKEGHQMKDCTERQANFLGKLWPSHKGRPGNFLQSRPEPTAPPEESFRFGEETTTSSQKQEPIDKELYPSASLRSLFGNDPSSQ

SEQ ID NO: 114 - protein, 500 aa, Human immunodeficiency virus
MGARASVLSGGELDRWEKIRLRPGGKKKYKLKHIVWASRELERFAVNPGLLETSAGCRQILGQLQPSLQTGSEELKSLYNTVATLYCVHQRIEIKDTKEALEKIEEEQNKSKKKAQQAAADTGNSSQASQNYPIVQNLQGQMVHQPISPRTLNAWVKVVEEKSFSPEVIPMFSALSEGATPQDLNTMLNSVGGHQAAMQMLKETINEEAAEWDRIHPVHAGPVAPGQMREPRGSDIAGTTSNLQEQINWMTSNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMSQATGSAAIMMQRGNFRNQRKSVKCFNCGKEGHIARNCRAPRKKGCWKCGKEGHQMKECTERQANFLGKIWPSHKGRPGNFLQSRPEPTAPPAESFRFGEETATPSQKQEPIDKELYPSASLKSLFGNDPSSQ

SEQ ID NO: 115 - protein, 501 aa, Human immunodeficiency virus
  variant (28)..(28): Xaa can be any naturally occurring amino acid
  variant (30)..(30): Xaa can be any naturally occurring amino acid
  variant (209)..(209): Xaa can be any naturally occurring amino acid
  variant (269)..(269): Xaa can be any naturally occurring amino acid
  variant (373)..(373): Xaa can be any naturally occurring amino acid
  variant (375)..(375): Xaa can be any naturally occurring amino acid
  variant (382)..(382): Xaa can be any naturally occurring amino acid
  variant (387)..(387): Xaa can be any naturally occurring amino acid
MGARASVLSGGKLDRWEKIRLRPGGRKXYXLKHLVWASRELERFAVNPGLLETSEGCRQILEQLQPALKTGSEELRSLYNAVATLYCVHQDIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEXAEWDRVHPVHAGPIAPGQMREPRGSDIAGTTSTLQEQIGWMTNNPPIPVGEIYKRWIILXLNKIVRMYSPTSILDIRQGPKEPFRDYVDRFYKTLRAEQASQEVKNWMTETLLVQNANPDCKTILKALGPAATLEDMMTACQGVGGPSHKARILAEAMSQVTNXAXIMIQRGXFRNPXKSVKCFNCGKEGHLARNCRAPRKKGCWKCGKEGHQMKDCTERQANFLGKIWPSHKGRPGNFLQSRPEPSAPPEESFRFGEKTTTPSQKQEPIDKEEQYPLASLKSLFGNDPSSQ

SEQ ID NO: 116 - protein, 502 aa, Human immunodeficiency virus
  variant (334)..(334): Xaa can be any naturally occurring amino acid
  variant (376)..(376): Xaa can be any naturally occurring amino acid
MGARASVLSGGKLDKWEKIRLRQGGRKKYKLKHLVWASRELERYAIDPGLLETAEGCRQILGQLQPALPTGSEELRSLHNAIATLYCVHQNIDIKDTKEALEKIEEEQNKSKKKAQQAAAGTGNSSSSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKXILKALGPAATLEEMMTACQGVGGPGHKARVLAEAMSHMTSQXTIMLQRGNFKNPGRPVKCFNCGKVGHIAKNCRAPRKKGCWKCGKEGHQMKDCTERQANFLGKIWPSNKGRPGNFLQSRPEPTAPPEESFRFGEETTTPSQKQEPIDKNLYPLTSLRSLFGNDPSSQ

SEQ ID NO: 117 - protein, 500 aa, Human immunodeficiency virus
MGARASVLSGGELDRWEKIRLRPGGKKKYRLKHVVWASRELERFAVNPGLLETSDGCRQILGQLQPALKTGSEELRSLFNTVATLYCVHQKIDVKDTKEALDKIEEEQNKSKKKAQQATADTGNSSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSHVTNSATIMMQKGNFRSQRKMVKCFNCGKEGHIAKNCRAPRKKGCWKCGKEGHQMKDCNERQANFLGKIRPSHKGRPGNFLQSRPEPTAPPEESFRFGEETTTPSQKQEQIDKELYPLTSLRSLFGNDPSSQ

SEQ ID NO: 118 - protein, 502 aa, Human immunodeficiency virus
MGARASILSGGKLDKWEKIRLRPGGKKSYQLKHLVWASRELERFAVNPGLLETAEGCRQILGQLQSSLKTGTEELRSLFNAVAVLYCVHQGIEVKDTKEALDKIEEEQNKSKKKAQQAEAADTGNNSNQVSQNYPIVQNLQGQMVHQAISPRTLNAWVKVVEEKAFSPEVIPMFAALSEGATPQDLNTMLNTVGGHQAAMQILKETINEEAAEWDRLHPVHAGPVAPGQMREPRGSDIAGTTSTLQEQIAWMTSNPPIPVGEVYKKWIIIGLNKIVRMYSPVSILDIRQGPKEPFRDYVDRFYKTLRAEQASQDVKNWMTETLLVQNANPDCKTILKALGPAATLEEMMAACQGVGGPGHKARVLAEAMSQVQNSATIMMQRGNPRNQRKTVKCFNCGKEGHIARNCRAPRKRGCWKCGKEGHQMKDCTERQANFLGKIWPSHKGRPGNFLQSRPEPSAPPEESFRFGEEATTPSQKQEQKDKEVYPLTSLRSLFGNDPLSQ

SEQ ID NO: 119 - protein, 502 aa, Human immunodeficiency virus
MGARASILSGGELDRWEKIRLRPGGNKRYKLKHIVWASRELERFAVNPGLLETSEGCRQILGQLQPSLKTGSEELKSLYNTVAVLYCVHERIEVKDTKEALDKIEEEQNKSKKKTQQAAADTGNSSQVSQNYPIIQNLQGQMVHQAISPRTLNAWVKVVEEKAFSPEVIPMFTALSEGATPHDLNTMLNTVGGHQAAMQMLKETINEEAAEWDRLHPVHAGPVAPGQMREPRGSDIAGTTSTLQEQIGWMTNNPPIPVGEIYKKWIIMGLNKIVRMYSPVSILDIRQGPKEPFREYVDRFYKTLRAEQASQDVKNWMTETLLIQNANPDCKTILKALGPGATLEEMMSACQGVGGPSHKARVLAEAMSQTTNAAAIMMQKGNFRNQRKIAKCFNCGKEGHIARNCRAPRKKGCWKCGKEGHQMKDCTERQANFLGKIWPSYKGRPGNFLQSRPEPTAPQPTAPPEESIRFGEETTTPSQKQEQKDKELYPLASLRSLFGNDQ

SEQ ID NO: 120 - protein, 500 aa, Human immunodeficiency virus
MGARASVLSGGELDRWEKIRLRPGGRKKYKLKHIVWASRELERFAVNPGLLETTAGCRQILEQLQPSLQTGSEELKSLYNTVATLYCVHQKIDVRDTKEALDKIEEEQNKSKRKAQQAAADTGNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVTNTTAIMMQKGNFRNQRKTVKCFNCGKEGHIARNCRAPRKKGCWKCGREGHQMKDCTERQANFLGKIWPSHKGRPGNFLQSRPEPTAPPEESLRFGGETTTPPQKQEPIDKELYPLASLKSLFGNDPLSQ

SEQ ID NO: 121 - protein, 502 aa, Human immunodeficiency virus
MGARASVLSGGKLDKWEKIRLRPGGKTKYKLQHLVWASRELERFAVNPGLLETAEGCRQILGQLQPSLQTGSEELKSLFNTIAVLYCVHQRIDVKDTKEAVDKIEEEQNKSKKKAQQAAADTGNSSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQMTNSATATIMMQKGNFRNQRRTVKCFNCGKEGHIAKNCRAPRKRGCWKCGKEGHQMKDCTERQANFLGKIWPSHKGRPGNFAQGRLEPTAPPEEGFRFGEETTTPPQKQEPIDKDLYPSVSLRSLFGNDPSSQ

SEQ ID NO: 122 - protein, 502 aa, Human immunodeficiency virus
  variant (85)..(85): Xaa can be any naturally occurring amino acid
  variant (391)..(391): Xaa can be any naturally occurring amino acid
MGARASVLSGGELDKWERIRLRPGGKKQYKLKHIVWASRELERFAVNPGLLETSEGCRKILGQLQPSLQTGSEELKSLYNTVAVXYCVHQRIEVKDTKEALDKIEEEQNKSKKKAQQAAADTGNSSQVSQNYPIVQNLQGQMVHQALSPRTLNAWVKVVEEKAFSPEVIPMFTALSEGATPQDLNTMLNTVGGHQAAMQMLKETINEEAAEWDRLHPVQAGPVAPGQLREPRGSDIAGTTSTLQEQIAWMTHNPPIPVGEIYKRWIIMGLNKIVRMYSPTSILDIRQGPKEPFRDYVDRFYKTLRAEQASQEVKNWMTETLLVQNANPDCKHILKALGPGATLEEMMTACQGVGGPGHKARVLAEAMSQVTNTSAILMQRGNFRNQRKTVXCFNCGKEGHIARNCRAPRKKGCWKCGKEGHQMKDCTERQANFLGKIWPSYKGRPGNFLQNRPEPIVPTAPPEESFRFGEETTPSRKPEQGDKEMYPLTSLKSLFGNDPLSQ

SEQ ID NO: 123 - protein, 499 aa, Human immunodeficiency virus
MGARASILRGGKLDRWEKIRLRPGGKKQYKLKHLVWASRELERFAVNPGLLETSDGCRKILGQLQPSLQTGSEELKSLYNTIAVLYCVHQNIDIKDTKEALDRIEEEQNKCKKKVQQAAADTGNNSQVSQNYPIVQNLQGQMVHQAISPRTLNAWVKVVEEKAFSPEVIPMFAALSEGATPQDLNTMLNTVGGHQAAMQILKETINEEAAEWDRLHPAQAGPVAPNQVRDPRGSDIAGTTSTLQEQIAWMTHNPPIPVGEIYKKWIIIGLNTIVRMYSPTSILGIKQGPKEPFRDYVDRFYRTLRAEQASQDVKNWMTETLLVQNANPDCKTILKALGPAATLEEMMTACQGVGGPGHKARVLAEAMSQVTNSATVMMQKNNFGNQRKIVKCFNCGRQGHIAKNCKAPRKKGCWKCGKEGHQMKDCTERQANFLGKIWPSHKGRPGNFLQSRPEPSAPPAESVRFGEETTPPQKQEPIDEERYPLTSLRSLFGNDPSSQ

SEQ ID NO: 124 - protein, 504 aa, Human immunodeficiency virus
MGARASVLSGGELDRWEKIRLRPGGKKKYRLKHIVWASRELERFAVNPGLLETSDGCRQILEQLQPSLQTGSEELRSLYNTIATLYCVHQRIEIKDTKEALDKIEEEQNKSKKKAQQAQQAAAAADTGNRGQVSQNFPIVQNLQGQMVHQPLSPRTLNAWVKVVEEKAFSPEVIPMFTALSEGATPQDLNTMLNTVGGHQAAMQMLKETINEEAAEWDRLHPVHAGPIAPGQMREPRGSDIAGTTSNLQEQIGWMTHNPPIPVGEIYKRWIILGLNKIVRMYSPTSILDIKQGPKEPFRDYVDRFYKTLRAEQASQEVKNWMTETLLVQNANPDCKTILKALGPGATLEEMMTACQGVGGPSHKARVLAEAMSQVNSATVMMQRGNIRNQRKAVKCFNCGKEGHIARNCRAPRKKGCWKCGKEGHQMKDCTERQANFLGKIWPSHKGRPGNFLQSRPEPTAPPEESFRFGERTTTPPQKQEQIDKDLYPLASLKSLFGNDPSSQ

SEQ ID NO: 125 - protein, 506 aa, Human immunodeficiency virus
  variant (41)..(41): Xaa can be any naturally occurring amino acid
  variant (223)..(223): Xaa can be any naturally occurring amino acid
MGARASVLSGGKLDQWEKIRLRPGGSKKYRLKHLVWASREXERFAVNPGLLETAEGCRQILGQLQPSLQTGSEELKSLYNTVATLYCVHQRIEIKDTKEALDKIEEEQSKSKKGAQQAAADTGNSSQVSQNYPIVQNLQGQMVHQAISPRTLNAWVKVVEEKAFSPEVIPMFSALAEGATPHDLNTMLNTVGGHQAAMQMLKETINEEAAEWDRLHPVHAGPXAPGQMREPRGSDIAGTTSTLQEQIGWMTHNPPIPVGEIYKKWIIMGLNKVVKMYSPISILEIRQGPKEPFREYVDRFYKTLRAEQATQEVKNWMTETLLVQNANPDCKTILKALGPGATLEEMMSACQGVGGPGHKARVLAEAMSQVTNSATIMMQKGNFRNQRKTVKCFNCGKEGHIARNCRAPRKKGCWKCGREGHQMKDCSERQANFLGKIWPSHKGRPGNFLQNRPEPTAPPEPTAPPAESFRFGEETATPSQKQEPKDKELYPLASLRSLFGNDPSSQ

SEQ ID NO: 126 - protein, 500 aa, Human immunodeficiency virus
  variant (399)..(399): Xaa can be any naturally occurring amino acid
  variant (477)..(477): Xaa can be any naturally occurring amino acid
MGARASVLSGGELDKWEKIRLRPGGKKKYKLKHIVWASRELERFAVNPGLLETSEGCRQILGQLQPSLQTGSEELRSLFNTVATLYCVHQKIEVKDTKEALDKIEEEQNKSKKKAQQSAADTGNKQPVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQMTNSNTVMMQRGNFRNQRKTVKCFNCGKEXHIAKNCRAPRKKGCWKCGKEGHQMKDCTERQANFLGRIWPSHKGRPGNFLQSRPEPSAPPEESFRFVEETTTPSQKQXPIDKELYPLTSLRSLFGNDPSSQ

SEQ ID NO: 127 - protein, 503 aa, Human immunodeficiency virus
  variant (13)..(13): Xaa can be any naturally occurring amino acid
  variant (22)..(22): Xaa can be any naturally occurring amino acid
  variant (28)..(28): Xaa can be any naturally occurring amino acid
  variant (52)..(52): Xaa can be any naturally occurring amino acid
  variant (67)..(67): Xaa can be any naturally occurring amino acid
  variant (102)..(102): Xaa can be any naturally occurring amino acid
  variant (128)..(128): Xaa can be any naturally occurring amino acid
  variant (130)..(130): Xaa can be any naturally occurring amino acid
  variant (170)..(170): Xaa can be any naturally occurring amino acid
  variant (316)..(316): Xaa can be any naturally occurring amino acid
  variant (382)..(382): Xaa can be any naturally occurring amino acid
  variant (421)..(421): Xaa can be any naturally occurring amino acid
MGARASVLSGGKXDRWEKIRLXPGGKKXYKLKHIVWASRELERFALNPGLLXTSEGCRQILEQLQPXIKTGTEELRSLFNTVSTLYCVHQKIDVKDTKEALXKIEEEQNKSKKKAQQAAAAAADTGNXSXVSQNYPIVQNLQGQMVHQALSPRTLNAWVKVVEEKAFSPXVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIIMGLNKIVRMYSPTSILDIKQGPKEPFRDYVDRFYKTLRAEQASQEXKNWMTETLLVQNSNPDCKTILKALGPGATLEEMMTACQGVGGPSHKARVLAEAMSQVTNPTTIMMXKGNFRNQRKPVKCFNCGKEGHISKNCRAPRKKGCWKCGXEGHQMKDCTERQANFLGKIWPSHKGRPGNFLQSRPEPTAPPEESLRFGEETTTPSQKQEPVDKELYPFSSLRSLFGNDPSSQ

SEQ ID NO: 128 - protein, 501 aa, Human immunodeficiency virus
  variant (13)..(13): Xaa can be any naturally occurring amino acid
  variant (122)..(122): Xaa can be any naturally occurring amino acid
  variant (168)..(168): Xaa can be any naturally occurring amino acid
  variant (190)..(190): Xaa can be any naturally occurring amino acid
  variant (248)..(248): Xaa can be any naturally occurring amino acid
  variant (251)..(251): Xaa can be any naturally occurring amino acid
  variant (309)..(309): Xaa can be any naturally occurring amino acid
  variant (337)..(337): Xaa can be any naturally occurring amino acid
  variant (390)..(390): Xaa can be any naturally occurring amino acid
  variant (404)..(404): Xaa can be any naturally occurring amino acid
  variant (443)..(443): Xaa can be any naturally occurring amino acid
  variant (469)..(469): Xaa can be any naturally occurring amino acid
MGARASVLSGGKXDQWEKIRLRPGGKKKYRLKHIVWASRELERFAVNPGLLETSEGCRQILGQLQPSLQTGSEELKSLYNTIAVLYCVHQRIEIRDTKEALDKIEEEQNKCKKRVQQAAADXGSSSQVSQNYPIVQNLQGQMVHQAISPRTLNAWVKVVEEKAFSPEXIPMFSALSEGATPQDLNTMLNXVGGHQAAMQMLKETINEEAAEWDRLHPVHAGPIAPGQMREPRGSDIAGTTSTLQEQVXWMXNNPPIPVGEIYKRWIIMGLNKVVRMYSPTSILDIRQGPKEPFRDYVDRFYKTLRAEQXSQEVKNWMTETLLVQNANPDCKTILKAXGPAATLEEMMTACQGVGGPGHKARVLAEAMSQATNSAAAIMMQKGNFKTHRKXVKCFNCGREGHIAXNCRAPRKRGCWKCGKEGHQMKDCTERQANFLGKIWPSHXGRPGNFLQSRPEPTAPPEEIFRFGEXTTTPTQKQEPIDKELSPLASLKSLFGNDPSSQ

SEQ ID NO: 129 - protein, 500 aa, Human immunodeficiency virus
  variant (107)..(107): Xaa can be any naturally occurring amino acid
  variant (307)..(307): Xaa can be any naturally occurring amino acid
MGARASVLSGGELDKWERIRLRPGGKKKYRLKHIVWASRELERYSLNPGLLETTEGCRQILGQLQPALQTGSEELKSLYNTIAVLYCVHQRVEVKDTKEALDRIEEXQNKCKKKAQQAAADTGNNSQVSQNFPIVQNAQGQMVHQSISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQVAWMTNNPPIPVGEIYKRWIILGLNKIVRMYSPTSILDIKQGPKEPFRDYVDRFYKTLRAXQASQDVKNWMTETLLVQNANPDCKTILKALGPAATLEEMMTACQGVGGPAYKAKVLAEAMSQATNSTNMMMQRGNFRNQRKIVKCFNCGKEGHIAKNCRAPRKKGCWKCGKEGHQMKECSERQANFLGKIWPSHKGRPGNFLQSRPEPTAPPEESFRFGEETATPPQKQEPIDKELYPSASLRSLFGNDPLLQ

SEQ ID NO: 130 - protein, 500 aa, Human immunodeficiency virus
  variant (411)..(411): Xaa can be any naturally occurring amino acid
MGARASVLSGGDLDRWEKIRLRPGGKKKYKLKHIVWASRELERFAVNPGLLETSKGCRQILEQLQPALQTGSEELKSLYNTVATLYCVHLKIEVKDTKEALDTIEKEQNKSKAKEQQAAADTGNSSKVSQNFPIVQNLQGQMVHQAISPRTLNAWVKVVEEKAFSPEVIPMFTALSEGATPQDLNTMLNTVGGHQAAMQMLKETINEEAAEWDRTHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQDVKNWMTETLLVQNANPDCRTILKALGPAATLEEMMTACQGVGGPGHKARVLAEAMSQVTNSTAIMMQKGNFGNQRKSIKCFNCGKVGHLARNCRAPRKXGCWKCGKEGHQMKDCTERQANFLGKIWPSSKGRPGNFLQSRPEPTAPPEESFRFGEEIATPSQKQGQMDKELYPSASLKSLFGNDPLSQ

SEQ ID NO: 131 - protein, 505 aa, Human immunodeficiency virus
  variant (126)..(126): Xaa can be any naturally occurring amino acid
  variant (398)..(398): Xaa can be any naturally occurring amino acid
MGARASVLSGGELDKWEKIRLRPGGKKKYRLKHIVWASRELERFAVNPGLLETSDGCRQILGQLQPALQTGSEELRSLYNTVATLYCVHQRIEVKDTKEALDKIEEEQNKSKKKAQQAAADTGNGXQSSGNQVSQNYPIVQNLQGQMVHQAITPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGDIYKRWIILGLNKIVRMYSPVSILDIRQGPKEPFRDYVDRFYKTLRAEQTTQEVKNWMTETLLVQNANPDCKTILKALGPAATLEEMMTACQGVGGPGHKARVLAEAMSQVTNSTSIMMQRGNFKNQRRTVKCXNCGKDGHIAKNCRAPRKKGCWKCGKEGHQMKDCNERQANFLGKIWPSHKGRPGNFLQSRPEPSAPPEESFSFGPETTTPSQKQEPIDQGVYPLTSLKSLFGNDPSSQ

SEQ ID NO: 132 - protein, 503 aa, Human immunodeficiency virus
  variant (76)..(76): Xaa can be any naturally occurring amino acid
  variant (88)..(88): Xaa can be any naturally occurring amino acid
  variant (90)..(90): Xaa can be any naturally occurring amino acid
  variant (188)..(188): Xaa can be any naturally occurring amino acid
  variant (292)..(292): Xaa can be any naturally occurring amino acid
  variant (348)..(348): Xaa can be any naturally occurring amino acid
  variant (389)..(389): Xaa can be any naturally occurring amino acid
  variant (478)..(478): Xaa can be any naturally occurring amino acid
MGARASVLSGGELDRWEKIRLRPGGKKKYRLKHIVWASRELERFAVNPGLLETSEGCRQILVQLQPSLQTGSEELXSLYNTIATLYCXHXRIEVKDTKEALEKIEEEQNKSKKKTQQAAADTRNNSQVSQNYPIVQNLQGQMVHQAISPRTLNAWVKVVEEKAFSPEVIPMFSALSEGATPQDLNTMXNTVGGHQAAMQMLKETINEEAAEWDRLHPVQAGPIAPGQIRDPRGSDIAGTTSTLQEQITWMTNNPPIPVGEIYKRWIIMGLNKIVRMYSPTSILDIRQGPKEXFRDYVDRFYKTLRAEQASQEVKNWMTETLLVQNANPDCKTILKALGPAATLEEMMXACQGVGGPGHKARVLAEAMSQVTNSANIMMQRGNFRPQRKXVKCFNCGKEGHIAKNCRAPRKKGCWKCGKEGHQIKDCTERQANFLGKIWPSHRERPGNFLQSRPEPTAPPAESFGFGEETTTPSQKQEXTDKEHKELYPLASLRSLFGNDPSSQ

SEQ ID NO: 133 - protein, 500 aa, Human immunodeficiency virus
  variant (76)..(76): Xaa can be any naturally occurring amino acid
  variant (486)..(486): Xaa can be any naturally occurring amino acid
MGARASVLSGGELDRLEKIRLRAGGKKKYRLKHVVWASRELEQFAINPGLLETSEGCRQILGQLQPALQTGSEELXSLYNTVATLYCVHKKLEIRDTQEALEKIEEEQNKSKKKAQQAAAGTGNSNQVSQNYPIVQNLQGQMVHQAISPRTLNAWVKVVEEKAFSPEVIPMFAALSEGATPQDLNTMLNTVGGHQAAMQMLKETINEEAAEWDRMHPVHAGPIAPGQMREPRGSDIAGTTSTLQEQIGWMTNNPPIPVGEIYKKWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTSSATIMMQKGNFRNQRRIVKCFNCGKEGHIAKNCRAPRKKGCWKCGKEGHQMKECTERQANFLGKIWPSHKGRPGNFLQSRPEPTAPPEESFRFGEETATPSQKQEPIDKEMYPXASLKSLFGNDPSSQ

SEQ ID NO: 134 - protein, 500 aa, Human immunodeficiency virus
  variant (18)..(18): Xaa can be any naturally occurring amino acid
  variant (127)..(127): Xaa can be any naturally occurring amino acid
  variant (189)..(189): Xaa can be any naturally occurring amino acid
  variant (215)..(215): Xaa can be any naturally occurring amino acid
  variant (283)..(283): Xaa can be any naturally occurring amino acid
  variant (361)..(361): Xaa can be any naturally occurring amino acid
  variant (449)..(449): Xaa can be any naturally occurring amino acid
  variant (451)..(451): Xaa can be any naturally occurring amino acid
  variant (481)..(481): Xaa can be any naturally occurring amino acid
MGARASVLSGGKLDKWEXIRLRPGGKKQYRLKHIVWASRELERFAVNPGLLETSDGCRQILIQLQPSIQTGSEELKSLYNTVATLYCVHQNIEIRDTKEALEKVEEEQNKSKKKAQQAAANTGNSSXVSQNYPIVQNLQGQMVHQPISARTLNAWVKVVEEKAFSPEVIPMFSALSEGATPQDLNTMLXTVGGHQAAMQMLKEAINEEAAEWDRXHPVHAGPIAPGQMREPRGSDIAGTTSTLQEQIGWMTSNPPIPVGEIYKRWIILGLNKIVRMYSPVSIXDIRQGPKEPFRDYVDRFYKTLRAEQASQDVKNWMTETLLVQNANPDCKTILKALGPAATLEEMMTACQGVGGPGHKAXVLAEAMSQATNTAAAIMMQRGNFRNQRKSVKCFNCGKEGHIARNCRAPRKKGCWKCGQEGHQMKDCTERQANFLGKIWPSHKGRPGNXLXSRPEPTAPPEESLRFGEETTTPSQKQEPEXKGYPLTSLRSLFGNDPSSQ

SEQ ID NO: 135 - protein, 500 aa, Human immunodeficiency virus
  variant (56)..(56): Xaa can be any naturally occurring amino acid
  variant (102)..(102): Xaa can be any naturally occurring amino acid
  variant (138)..(138): Xaa can be any naturally occurring amino acid
  variant (147)..(147): Xaa can be any naturally occurring amino acid
  variant (159)..(159): Xaa can be any naturally occurring amino acid
  variant (252)..(252): Xaa can be any naturally occurring amino acid
  variant (286)..(286): Xaa can be any naturally occurring amino acid
  variant (322)..(322): Xaa can be any naturally occurring amino acid
  variant (331)..(331): Xaa can be any naturally occurring amino acid
  variant (385)..(385): Xaa can be any naturally occurring amino acid
  variant (460)..(460): Xaa can be any naturally occurring amino acid
  variant (470)..(470): Xaa can be any naturally occurring amino acid
  variant (479)..(479): Xaa can be any naturally occurring amino acid
  variant (483)..(483): Xaa can be any naturally occurring amino acid
MGARASVLSGGELDKWEKIRLRPGGKKQYKLKHIVWASRELERFAVNPGLLETAKXCSQILEQLQPSLQTGSEELRSLYNTVATLYCVHQKIEVKDTKEALXKVEEEQNKSKKKAQQAAADTRNSSQVSQNYPIVQNXQGQMVHQPXSPRTLNAWVKVXEEKAFSPEVIPMFSALSEGATPQDLNTMLNTVGGHQAAMQMLKETINEEAADWDRLHPVHAGPIAPGQMREPRGSDIAGTTSTLQEQIGWMTXNPPIPVGEIYKRWIILGLNKIVRMYSPTSILDIXQGPKEPFRDYVDRFYKTLRAEQASQEVKNWMTETLXVQNANPDCXTILKALGPAATLEEMMTACQGVGGPGHKARVLAEAMSQVTNSATVMMQRGNFRXQRKTVKCFNCGKEGHIARNCRAPRKKGCWKCGKEGHQMKDCTERQANFLGKIWPSHKGRPGNFLQSRPEPTAPPXESFRFGEETXTPSQKQETXDKEXYPLASLRSLFGNDPSSQ

SEQ ID NO: 136 - protein, 500 aa, Human immunodeficiency virus
  variant (28)..(28): Xaa can be any naturally occurring amino acid
  variant (52)..(52): Xaa can be any naturally occurring amino acid
  variant (66)..(66): Xaa can be any naturally occurring amino acid
  variant (84)..(84): Xaa can be any naturally occurring amino acid
  variant (105)..(105): Xaa can be any naturally occurring amino acid
  variant (118)..(118): Xaa can be any naturally occurring amino acid
  variant (188)..(188): Xaa can be any naturally occurring amino acid
  variant (219)..(219): Xaa can be any naturally occurring amino acid
  variant (415)..(415): Xaa can be any naturally occurring amino acid
  variant (485)..(485): Xaa can be any naturally occurring amino acid
MGARASVLSGGELDRWEKIRLRPGGKKXYQLKHIVWASRELERFAVNPGLLXTSEGCRQILGQLQXSLQTGSEELKSLYNTVAXLYCVHQRIEVKDTKEALEKVXEEQNKSKKQAQQXAADTAKSSQVSQNYPIVQNIQGQMVHQAISPRTLNAWVKVVEEKAFSPEVIPMFSALSEGATPQDLNTMXNTVGGHQAAMQMLKETINEEAAEWDRLHPVXAGPVAPGQMREPRGSDIAGTTSTLQEQIGWMTSNPAIPVGEIYKRWIIMGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNSATIMMQRGNFKNQRKTVKCFNCGKEGHIARNCRAPRKKGCWXCGKEGHQMKDCTERQANFLGKIWPSHKGRPGNFLQSRPEPTAPPAPPEESFRFGEETITPPQRQEPTDKXMYPLASLKSLFGSDP

SEQ ID NO: 137 - protein, 501 aa, Human immunodeficiency virus
  variant (182)..(182): Xaa can be any naturally occurring amino acid
MGARASVLSGGKLDRWEKIRLRPGGKKKYKLKHIVWASRELERFAVNPGLLETSEGCRQILGQLQPSLQTGSEELKSLYNTIATLYCVHQRIEIKDTKEALDKIEEEQNKSKKKAQPAAAAAAGNDNQVSQNYPIVQNLQGQMVHQPLSPRTLNAWVKVIEEKAFSPEVIPMFTALSEGATXQDLNTMLNTVGGHQAAMQMLKETINEEAAEWDRLHPPQAGPVAPGQMRDPRGSDIAGTTSTLQEQIGWMTSNPPIPVGEIYKRWIILGLNKIVRMYSPISILDIRQGPKEPFRDYVDRFYKTLRAEQASQDVKNWMTETLLVQNANPDCKTILKALGPGASLEEMMTACQGVGGPSHKARVLAEAMSQATNTATIMMQKGNFKNQRKMVKCFNCGKEGHIAKNCRAPRKKGCWKCGREGHQMKDCTERQANFLGKIWPSHKGRPGNFLQSRPEPTAPPEESFRFGEEAAAPPQKQEPTDKEMYPLASLRSLFGNDPSSQ

SEQ ID NO: 138 - protein, 502 aa, Human immunodeficiency virus
  variant (260)..(260): Xaa can be any naturally occurring amino acid
  variant (286)..(286): Xaa can be any naturally occurring amino acid
  variant (409)..(409): Xaa can be any naturally occurring amino acid
  variant (449)..(449): Xaa can be any naturally occurring amino acid
MGARASVLSGGELDKWEKIRLRPGGKKRYKLKHIVWASRELERFAVNPGLLETSEGCRQIMVQLQPSLQTGSEELKSLYNTVATLYCVHQRIDVKDTKEALDKIEEEQNKCKKKAQQAAADTGNSSQISQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGXIYKRWIILGLNKIVRMYSPTSILDIXQGPKEPFRDYVDRFYKTLRAEQASQEVKNWMTDTLLVQNANPDCKTILKALGPGATLEEMMTACQGVGGPSHKARILAEAMSQANSAAIMMQKGNFKNQRRTVKCFNCGKEGHVAKNCRAPRXKGCWKCGQEGHQMKDCTARQANFLGKIWPSSKGRPGNFLXSRPEPTAPPAPPEESFRFGEETTTPSQKQEPTDKSLYPLASLRSLFGNDPSSQ

SEQ ID NO: 139 - protein, 498 aa, Human immunodeficiency virus
  variant (76)..(76): Xaa can be any naturally occurring amino acid
  variant (139)..(139): Xaa can be any naturally occurring amino acid
  variant (164)..(164): Xaa can be any naturally occurring amino acid
  variant (390)..(390): Xaa can be any naturally occurring amino acid
  variant (392)..(392): Xaa can be any naturally occurring amino acid
  variant (408)..(408): Xaa can be any naturally occurring amino acid
MGARASVLSGGELDRWEKIRLRPGGKKKYNLKHVVWASRELERFAVNPGLLETAEGCRQILGQLQPSLRTGSEELXSLYNTVATLYCVHQKIEVKDTKEALDKIEEEQNRSKKKAQQAATDTGSKEQISQNYPIVQNLXGQMVHQAISPRTLNAWVKVIEEKAXSPEVIPMFSALSEGATPQDLNTMLNTVGGHQAAMQMLKETINEEAAEWDRLHPVHAGPAAPGQMREPRGSDIAGSTSTLQEQIGWMTSNPPIPVGEIYKRWIILGLNKIVRMYSPVSILDIKQGPKEPFRDYVDRFYKTLRAEQATQEVKNWMTETLLVQNANPDCKTILKALGPAATLEEMMTACQGVGGPGHKARILAEAMSQATSAAIMMQRGNFRDKRKTVXCXNCGREGHIAKNCRAPXKKGCWKCGKEGHQMKECTERQANFLGKIWPSHKGRPGNFLQSKVEPTAPPEESIRFGEETTPSQKQEPIDKELYPLASLKSLFGNDPSSQ

SEQ ID NO: 140 - protein, 500 aa, Human immunodeficiency virus
  variant (11)..(11): Xaa can be any naturally occurring amino acid
  variant (24)..(24): Xaa can be any naturally occurring amino acid
  variant (53)..(53): Xaa can be any naturally occurring amino acid
  variant (103)..(103): Xaa can be any naturally occurring amino acid
  variant (113)..(113): Xaa can be any naturally occurring amino acid
  variant (136)..(136): Xaa can be any naturally occurring amino acid
  variant (145)..(145): Xaa can be any naturally occurring amino acid
  variant (164)..(164): Xaa can be any naturally occurring amino acid
  variant (167)..(167): Xaa can be any naturally occurring amino acid
  variant (235)..(235): Xaa can be any naturally occurring amino acid
  variant (249)..(249): Xaa can be any naturally occurring amino acid
  variant (313)..(313): Xaa can be any naturally occurring amino acid
  variant (380)..(380): Xaa can be any naturally occurring amino acid
  variant (463)..(463): Xaa can be any naturally occurring amino acid
  variant (465)..(465): Xaa can be any naturally occurring amino acid
  variant (479)..(479): Xaa can be any naturally occurring amino acid
  variant (486)..(486): Xaa can be any naturally occurring amino acid
MGARASVLSGXELDRWEKIRLRPXGKKKYKLKHIVWASRELERFAVNPGLLEXSEGCRKILEQLQPSLQTGSEELKSLFNTVATLYCVHQRIEIKDTKEALEXIEEEQNKSKXKAQQAAADTGNSSSQVSQNYPIXQNIQGQMVXQAISPRTLNAWVKVIEEKXFSXEVIPMFSALSEGATPQDLNTMLNTVGGHQAAMQMLKETINEEAAEWDRLHPVHAGPIAPGQMREPRGXDIAGTTSTLQEQIXWMTHNPPIPVGDIYKRWIIMGLNKIVRMYSPVSILDIRQGPKEPFRDYVDRFYKTLRAEQASQXVKNWMTETLLVQNANPDCKTILKALGPAATLEEMMTACQGVGGPSHKARVLAEAMSQTNSATIMMQXGNFRNPKKTVKCFNCGKEGHIARNCRAPRKKGCWKCGKEGHQMKDCSERQANFLGRLWPSHKGRPGNFLQSRPEPTAPPEESXSXREEITTPPQKQEPXDKTMYPXTSLRSLFGNDPSSQ

SEQ ID NO: 141 - protein, 505 aa, Human immunodeficiency virus
MGARASVLSGGELDRWEKIRLRPGGKKQYKLKHIVWASRELERFAVNPSLLETSEGCKQILAQLQPSLQTGSEELKSLYNTIAVLYCVHQRIEVKDTKEALDKIEEEQNKSKKKVQQQQAAAAAGSSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNPATVMMQRGNFRNQRKIVKCFNCGKEGHIARNCRAPRKKGCWKCGKEGHQMKDCTERQANFLGKIWPSHKGRPGNFLQSRPEPTAPPAPPEESFRFGEETAAPSQKQEPIDKELYPLASLKSLFGNDPSSQ

SEQ ID NO: 142 - protein, 510 aa, Human immunodeficiency virus
MGARASVLSGGELDRWEKIRLRPGGKKRYKLKHIVWASRELERFAVNPGLLETSEGCRQILGQLQPSLQTGSEELKSLYNTIAVLYCVHQRIEVKDTKEALEKIEEEQNKSKKKAQQAAADTGNSGTNTGNSGTVSQNYPIVQNLQGQMVHQPLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQMTNPASIMMQRGNYRNQRKTVKCFNCGKEGHIARNCRAPRKKGCWKCGKEGHQMKDCTERQANFLGKIWPSHKGRPGNFLQSRPEPTAPPAPPEESFMFGEETTTPPQKQESIDKGGYPLTSLRSLFGNDPSSQ

SEQ ID NO: 143 - protein, 500 aa, Human immunodeficiency virus
MGARASVLSGGELDRWEKIRLRPGGNKRYRLKHIVWASRELERFAVNPGLLETAGGCRQILAQLQPSLQTGSEELKSLFNTVATLYCVHQRIEVKDTKEALEKIEEEQNKSKKKAQPAAADAGTSSQASQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTGSATIMMQRGNFKNQRKTVKCFNCGKEGHIARNCRAPRKKGCWKCGREGHQMKDCTERQANFLGKIWPSHKGRPGNFLQSRPEPTAPPEESFRFGEETTTPPQKQEPIDKEVYPLTSLKSLFGNDPSSQ

SEQ ID NO: 144 - protein, 503 aa, Human immunodeficiency virus
  variant (46)..(46): Xaa can be any naturally occurring amino acid
  variant (264)..(264): Xaa can be any naturally occurring amino acid
  variant (422)..(422): Xaa can be any naturally occurring amino acid
  variant (479)..(479): Xaa can be any naturally occurring amino acid
  variant (481)..(481): Xaa can be any naturally occurring amino acid
MGARASVLSGGELDRWEKIRLRPGGKKKYKLKHIVWASRELERFAXNPGLLETSGGCRQILEQLQPALQTGSEELKSLFNTVATLYCVHQKIDVRDTKEALDKIEEEQNKSKKKAPQTAAAAADAGSNSKVSLNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSNLQEQIAWMTNNPPIPVGEXYKRWIILGLNKIVRMYSPVSILDIRQGPKEPFRDYVDRFYKTLRAEQATQEVKNWMTETLLVQNANPDCKTILKALGPGATLEEMMTACQGVGGPGHKARVLAEAMSQMTNSATVMMQRGNFKGQRKIVKCFNCGKEGHIAKNCRAPRKKGCWKCGKXGHQMKDCDRQANFLGKIWPSSKGRPGNFLQSRPEPTAPPEESFRFGEETTPPQKQEXTXRDKELYPLASLKSLFGNDPSSQ

SEQ ID NO: 145 - protein, 494 aa, Human immunodeficiency virus
  variant (41)..(41): Xaa can be any naturally occurring amino acid
  variant (44)..(44): Xaa can be any naturally occurring amino acid
  variant (180)..(180): Xaa can be any naturally occurring amino acid
  variant (258)..(258): Xaa can be any naturally occurring amino acid
  variant (301)..(301): Xaa can be any naturally occurring amino acid
  variant (307)..(307): Xaa can be any naturally occurring amino acid
  variant (316)..(316): Xaa can be any naturally occurring amino acid
MGARASVLSGGELDKWEKIRLRPGGKKKYQLKHIVWASREXERXAVNPGLLETSEGCRQILGQLQPSLQTGSEELRSLYNTVATLYCVHQRIDVKDTKEALDKVEEEQDKSKKKAQQAAADSSQVSQNYPIVQNMQGQMVHQAISPRTLNAWVKVVEEKAFSPEVIPMFAALSEGATPQXLNTMLNTVGGHQAAMQMLKETINEEAAEWDRLHPVHAGPIAPGQMREPRGSDIAGTTSTLQEQIGWMTSNPPTPVGEXYKRWIILGLNKIVRMYSPTSILDIRQGPKEPFRDYVDRFYKTXRAEQAXQEVKNWMTXTLLVQNANPDCKTILKALGPGATLEDMMTACQGVGGPGHKARVLAEAMSQVNPATIMVQRGNFRNQRKTVKCFNCGKEGHVARNCRAPRKKGCWKCGKEGHQMKDCTERQVNFLGKIWPSHKERPGNFFQSRPEPTAPPAESFREETTTPSQKQEPKDKELYPLASLKSLFGNDPSSQ

SEQ ID NO: 146 - protein, 500 aa, Human immunodeficiency virus
MGARASVLSGGQLDRWEKIRLRPGGKKKYKLKHIVWASRELERFAVNPGLLETGEGCRQILAQLQPSLQTGSEELKSLYNAVATLYCVHQKIEVKDTKEALEKVEEEQNRSKRKVQQAAADTGNSSTISQNFPIVQNLQGQMVHQSLSPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNSNPDCKTILKAMGPGATLEEMMTACQGVGGPGHKARVLAEAMSQVTSPANIMMQRGNFKNQRKIVKCFNCGKDGHIAKNCRAPRKKGCWKCGKEGHQMKECTERQVNFLGKIWPSHKGRPGNFLQSRLEPTAPPEESVRFGEETTTPSQKQEPIDKELYPLTSLKSLFGNDPSSQ

SEQ ID NO: 147 - protein, 504 aa, Human immunodeficiency virus
  variant (88)..(88): Xaa can be any naturally occurring amino acid
  variant (91)..(91): Xaa can be any naturally occurring amino acid
  variant (110)..(110): Xaa can be any naturally occurring amino acid
  variant (119)..(119): Xaa can be any naturally occurring amino acid
  variant (177)..(177): Xaa can be any naturally occurring amino acid
  variant (215)..(215): Xaa can be any naturally occurring amino acid
  variant (482)..(482): Xaa can be any naturally occurring amino acid
MGARASVLSGGKLDKWEKIRLRPGGKKKYKLKHIVWASRELERFAVNPGLLETSEGCRQILRQLQPSLQTGSEELKSLYNTVATLYCXHQXIEVKDTKEALDRIEEEQNXCKKKAQQAXADTGNSNQVSQNYPIVQNMQGQMVHQAISPRTLNAWVKVVEEKAFSPEVIPMFSALSXGATPQDLNTMLNTVGGHQAAMQMLKETINEEAAEWDRXHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFGNQKRKVKCFNCGKEGHIAKNCRAPRRKGCWKCGKEGHQMKDCIERQVNFLGKIWPSHKEGRPGNFLQSRPEPTAPPAPPEESFRFGEGTTTPSQKQEXTDKELYPLASLKSLFGNDPLLQ

SEQ ID NO: 148 - protein, 500 aa, Human immunodeficiency virus
  variant (67)..(67): Xaa can be any naturally occurring amino acid
  variant (79)..(79): Xaa can be any naturally occurring amino acid
  variant (82)..(82): Xaa can be any naturally occurring amino acid
  variant (111)..(111): Xaa can be any naturally occurring amino acid
  variant (143)..(143): Xaa can be any naturally occurring amino acid
  variant (207)..(207): Xaa can be any naturally occurring amino acid
  variant (218)..(218): Xaa can be any naturally occurring amino acid
  variant (252)..(252): Xaa can be any naturally occurring amino acid
  variant (275)..(275): Xaa can be any naturally occurring amino acid
  variant (292)..(292): Xaa can be any naturally occurring amino acid
  variant (340)..(340): Xaa can be any naturally occurring amino acid
  variant (350)..(350): Xaa can be any naturally occurring amino acid
  variant (388)..(388): Xaa can be any naturally occurring amino acid
  variant (427)..(427): Xaa can be any naturally occurring amino acid
  variant (443)..(443): Xaa can be any naturally occurring amino acid
  variant (446)..(446): Xaa can be any naturally occurring amino acid
  variant (448)..(448): Xaa can be any naturally occurring amino acid
  variant (473)..(473): Xaa can be any naturally occurring amino acid
  variant (477)..(477): Xaa can be any naturally occurring amino acid
  variant (490)..(490): Xaa can be any naturally occurring amino acid
  variant (500)..(500): Xaa can be any naturally occurring amino acid
MGARASVLSGGKLDKWERIRLRPGGKKKYRLKHIVWASRELERFAVNSGLLETSEGCRQILGQLQPXLQTGSEELRSLXNTXATLYCVHQGIDIKDTKEALDKIEEEQNKXKKKAKQAEADAGNNSQVSQNYPIVQNAQGQMXHQAISPRTLNAWVKVVEEKAFSPEVIPMFSALSEGATPQDLNTMLNTVGGHQAAMQMLKETINXEAAEWDRLHPXHAGPIAPGQMREPRGSDIAGTTSTLQEQIGWMTXNPPIPVGEIYKRWIIMGLNKIVXMYSPTSILDIKQGPKEXFRDYVDRFYKTLRAEQATQEVKNWMTETLLVQNANPDCKTILKALGPXATLEEMMTAXQGVGGPAHKARVLAEAMGQVTNSNIIMMQKGNFRNQRXTVKCFNCGREGHIARNCKAPRKKGCWKCGREGHQMKDCXERQANFLGKIWPSHKXRPXNXLQSRPEPTAPPEESFRFGEETATPXQKQXPIDKELYPLASLXSLFGNDPSSX

SEQ ID NO: 149 - protein, 503 aa, Human immunodeficiency virus
  variant (21)..(21): Xaa can be any naturally occurring amino acid
  variant (24)..(24): Xaa can be any naturally occurring amino acid
  variant (56)..(56): Xaa can be any naturally occurring amino acid
  variant (138)..(138): Xaa can be any naturally occurring amino acid
  variant (149)..(149): Xaa can be any naturally occurring amino acid
  variant (157)..(157): Xaa can be any naturally occurring amino acid
  variant (183)..(183): Xaa can be any naturally occurring amino acid
  variant (212)..(212): Xaa can be any naturally occurring amino acid
  variant (263)..(263): Xaa can be any naturally occurring amino acid
  variant (282)..(282): Xaa can be any naturally occurring amino acid
  variant (286)..(286): Xaa can be any naturally occurring amino acid
  variant (388)..(388): Xaa can be any naturally occurring amino acid
  variant (392)..(392): Xaa can be any naturally occurring amino acid
  variant (401)..(401): Xaa can be any naturally occurring amino acid
  variant (446)..(446): Xaa can be any naturally occurring amino acid
  variant (462)..(462): Xaa can be any naturally occurring amino acid
  variant (472)..(472): Xaa can be any naturally occurring amino acid
MGARASVLSGGELDRWEKIRXRPXGKKTYKLKHIVWASRELERFAVNPGLLETSDXCRQILGQLQPSLQTGSEELKSLYNTIAVLYCVHQRIQVKDTKEALDQIEEEQNRCKKKAQQAAADTGNSSQVSQVSQNYPIXQNMQGQMVHQXISPRTLNXWVKVVEEKAFSPEVIPMFTALSEGAXPQDLNTMLNTVGGHQAAMQMLKDTINEEXAEWDRLHPVHAGPVAPGQMREPRGSDIAGTTSTLQEQIGWMTSNPPMPVGXIYKRWIILGLNKIVRMYSXTSIXDIKQGPKEPFRDYVDRFYKTLRAEQASADVKGWMTETLLVQNANPDCKTILKALGPGATLEEMMTACQGVGGPGHKARVLAEAMSQVTNSATIMMQKGNFRXQRKXVKCFNCGKXGHIAKNCRAPRKRGCWKCGKEGHQMKDCTERQANFLGKIWPSHKXRPGNFLQSRPEPTAPXEESFRFGEEXATPSQKQEPIDKELYPLASLKSLFGNDHSSQ

SEQ ID NO: 150 - protein, 500 aa, Human immunodeficiency virus
  variant (12)..(12): Xaa can be any naturally occurring amino acid
  variant (63)..(63): Xaa can be any naturally occurring amino acid
  variant (65)..(65): Xaa can be any naturally occurring amino acid
  variant (77)..(77): Xaa can be any naturally occurring amino acid
  variant (88)..(88): Xaa can be any naturally occurring amino acid
  variant (114)..(114): Xaa can be any naturally occurring amino acid
  variant (151)..(151): Xaa can be any naturally occurring amino acid
  variant (179)..(179): Xaa can be any naturally occurring amino acid
  variant (295)..(295): Xaa can be any naturally occurring amino acid
  variant (342)..(342): Xaa can be any naturally occurring amino acid
  variant (386)..(386): Xaa can be any naturally occurring amino acid
  variant (460)..(460): Xaa can be any naturally occurring amino acid
  variant (465)..(465): Xaa can be any naturally occurring amino acid
  variant (487)..(487): Xaa can be any naturally occurring amino acid
MGARASVLSGGXLDQWEKIRLRPGGKKKYKLKHIVWASRELERFAVNPGLLETSEGCRQILGXLXPSLQTGSEELKXLFNTVATLYCXHQRIDVKDTKEALEKIEEEQNKSKKXAQQAAADTEKSSQVSQNYPIVQNLQGQMVHQAISPRXLNAWVKVVEEKAFSPEVIPMFSALSEGXTPQDLNTMLNTVGGHQAAMQMLKETINEEAAEWDRLHPVHAGPIAPGQMREPRGSDIAGTTSTLQEQVAWMTANPAIPVGEIYKRWIILGLNKIVRMYSPTSILDIRQGPKEPFRXYVDRFYRTLRAEQASQEVKNWMTETLLVQNANPDCKTILKALGPAAXLEEMMTACQGVGGPSHKARVLAEAMSQAQTPNSIMMQRGNFRNXRKNVKCFNCGKEGHIAKNCRAPRKKGCWKCGKEGHQMKDCNERQANFLGKIWPSYKGRPGNFLQSRPEPSAPPXESFRXGEETTTPPQKQEPIDKEQYPLXSLRSLFGNDPSST

SEQ ID NO: 151 - protein, 503 aa, Human immunodeficiency virus
  variant (67)..(67): Xaa can be any naturally occurring amino acid
  variant (220)..(220): Xaa can be any naturally occurring amino acid
  variant (257)..(257): Xaa can be any naturally occurring amino acid
  variant (442)..(442): Xaa can be any naturally occurring amino acid
  variant (465)..(465): Xaa can be any naturally occurring amino acid
MGARASVLSGGDLDRWEKIRLRPGGKKQYKLKHLVWASRELERFAVNPGLLETAEGCRQILEQLQPXLQTGSEELKSLYNTVAVLYCVHQRIKVADTKEALEKLEEEQNKSKKKTQQAAAAATGTGNSSQVSQNYPIVQNLQGQMVHQAISPRTLNAWVKVVEEKAFSPEVIPMFSALSEGATPQDLNTMLNTVGGHQAAMQMLKETINEEAAEWDRVHXVHAGPIAPGQMREPRGSDIAGTTSTLQEQIGWMTNNXPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSASIMMQRGNFRNQRKAVKCFNCGKEGHIARNCRAPRKKGCWKCGKEGHQMKDCTERQANFLGKIWXSHKGRPGNFLQSRPEPTAPPAEXFRFGEETTTPSQKQEPIDREVYPLTSLRSLFGNDPSSQ

SEQ ID NO: 152 - protein, 500 aa, Human immunodeficiency virus
  variant (27)..(27): Xaa can be any naturally occurring amino acid
  variant (78)..(78): Xaa can be any naturally occurring amino acid
  variant (123)..(123): Xaa can be any naturally occurring amino acid
  variant (191)..(191): Xaa can be any naturally occurring amino acid
  variant (219)..(219): Xaa can be any naturally occurring amino acid
  variant (246)..(246): Xaa can be any naturally occurring amino acid
  variant (256)..(256): Xaa can be any naturally occurring amino acid
  variant (363)..(363): Xaa can be any naturally occurring amino acid
  variant (393)..(393): Xaa can be any naturally occurring amino acid
  variant (443)..(443): Xaa can be any naturally occurring amino acid
  variant (467)..(467): Xaa can be any naturally occurring amino acid
  variant (470)..(470): Xaa can be any naturally occurring amino acid
  variant (486)..(486): Xaa can be any naturally occurring amino acid
  variant (490)..(490): Xaa can be any naturally occurring amino acid
  variant (500)..(500): Xaa can be any naturally occurring amino acid
MGARASVLSGGELDKWERIRLRPGGKXTYQLKHIVWASRELERFAVNPGLLETSEGCRQILGQLHPSLQTGSEELKSXYNTIAVLYCVHQRIEIRDTKEALDKIEEEQNKSKKKAQPAAADTXNSSQVSQNYPIVQNMQGQMVHQSISPRTLNAWVKVVEEKAFSPEVIPMFAALSEGATPQDLNTMLNTXGGHQAAMQMLKETINEEAAEWDRLHPVXAGPVAPGQMRDPRGSDIAGTTSTLQEXIGWMTSNPPXQVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVXAEAMSQVTNTATIMAQRGNFRNQRKIVKCXNCGKEGHIARNCRAPRKKGCWKCGKEGHQMKDCTERQANFLGKIWPSHKXRPGNFLQNRPEPSAPPAESFKFGXETXTPPQKQDPIDKELYPXASLXSLFGNDPSSX

SEQ ID NO: 153 - protein, 508 aa, Human immunodeficiency virus
  variant (97)..(97): Xaa can be any naturally occurring amino acid
  variant (186)..(186): Xaa can be any naturally occurring amino acid
  variant (310)..(310): Xaa can be any naturally occurring amino acid
MGARASVLSGGELDKWEKIRLRPGGKKKYRLKHLVWASRELERFAVNPGLLETSEGCRQILGQLQPSLQTGSEELKSLYNTVAVLYCVHQRIEIKDXKEALDKIEEEQNKSKKKAQQAAADTGNNSSQVSQNYPIVQNMQGQMVHQAISPRTLNAWVKVVEEKAFSPEVIPMFSALSEGATPQDLXTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQXSQEVKNWMTETLLVQNANPDCKTILKALGPAATLEEMMTACQGVGGPSHKAKIMAEAMSQITNSAAIMMQKGNFRNQRKPVKCFNCGKEGHIARNCRAPRKRGCWKCGKEGHQMKDCTERQANFLGKIWPSHKGRPGNFLQNRPDPPAPRPEPSAPPMESFRFGEETTTPSQKKEEIDKELYPLASLKSLFGNDPLSQ

SEQ ID NO: 154 - protein, 500 aa, Human immunodeficiency virus
  variant (254)..(254): Xaa can be any naturally occurring amino acid
MGARASVLSAGELDRWEKIRLRPGGKKQYRLKHLVWASRELERFAVNPGLLETSEGCRQILTQLQPSLQTGSEELKSLYNTVATIYCVHQKIDVKDTMEALEKIEEEQNRSKKKAQQAAATENSSQGQGSQNYPIVQNIQGQMVHQAISPRTLNAWVKVVEEKAFSPEVIPMFSALSEGATPQDLNTMLNTVGGHQAAMQMLKETINEEAAEWDRLHPVQAGPIAPGQIREPRGSDIAGTTSNLQEQIAWMTNXPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATTMMQRGNFRNPRKNVKCFNCGKEGHIARNCRAPRKKGCWKCGKEGHQMKDCTERQANFLGKIWPSHKGRPGNFLQSRPEPTAPPEESFRFGEEATPSQKQEPIDKELYPLASLRSLFGSDPSSQ

SEQ ID NO: 155 - protein, 499 aa, Human immunodeficiency virus
  variant (27)..(27): Xaa can be any naturally occurring amino acid
  variant (30)..(30): Xaa can be any naturally occurring amino acid
  variant (41)..(41): Xaa can be any naturally occurring amino acid
  variant (63)..(63): Xaa can be any naturally occurring amino acid
  variant (65)..(65): Xaa can be any naturally occurring amino acid
  variant (69)..(69): Xaa can be any naturally occurring amino acid
  variant (79)..(79): Xaa can be any naturally occurring amino acid
  variant (126)..(126): Xaa can be any naturally occurring amino acid
  variant (136)..(136): Xaa can be any naturally occurring amino acid
  variant (138)..(138): Xaa can be any naturally occurring amino acid
  variant (197)..(197): Xaa can be any naturally occurring amino acid
  variant (233)..(233): Xaa can be any naturally occurring amino acid
  variant (268)..(268): Xaa can be any naturally occurring amino acid
  variant (278)..(278): Xaa can be any naturally occurring amino acid
  variant (306)..(306): Xaa can be any naturally occurring amino acid
  variant (322)..(322): Xaa can be any naturally occurring amino acid
  variant (361)..(361): Xaa can be any naturally occurring amino acid
  variant (407)..(407): Xaa can be any naturally occurring amino acid
  variant (449)..(449): Xaa can be any naturally occurring amino acid
  variant (452)..(452): Xaa can be any naturally occurring amino acid
  variant (476)..(476): Xaa can be any naturally occurring amino acid
  variant (486)..(486): Xaa can be any naturally occurring amino acid
MGARASVLSGGKLDKWEKIRLRPGGRXQYXLKHLVWASREXERFAVNPGLLETGEGCKQILEXLXPALXTGSEELKSLXNTVATLYCVHQKIEVRDTKEALDKIEEEQNKSKKKAQQAAADAGNNXQVSQNYPIVXNXQGQMVHQAISPRTLNAWVKVVEEKAFSPEVIPMFSALSEGATPQDLNTMLNTVGGHQAXMQMLKETINEEAAEWDRLHPVHAGPIAPGQIREPRXSDIAGTTSTLQEQIAWMTNNPPIPVGEIYKRWIIXGLNKIVRMYXPTSILDIRQGPKEPFRDYVDRFYKTLRXEQASQEVKNWMTETLXVQNSNPDCKTILKALGPAATLEEMMTACQGVGGPGHKAXILAEAMSQVTNSATIMMQKGNFRNQRKIVKCFNCGKEGHIARNCRXPRKKGCWKCGKEGHQMKDCTERQANFLGKIWPSYKGRPGNFXQSXPEPTAPPAESFRFGEETTPPQKQXQIDKELYPSXSLRSLFGNDPSSQ

SEQ ID NO: 156 - protein, 500 aa, Human immunodeficiency virus
  variant (375)..(375): Xaa can be any naturally occurring amino acid
MGARASVLSGGKLDKWEKIRLRPGGKKKYQLKHIVWASRELERFAVNPGLLETAEGCRQILGQLQPSLQTGTEELKSLYNTLAVLYCVHQNIEVKDTKEALDKIEEEQNQSKKKAQQATANTGNSNQVSQNYPIVQNLQGQMVHQAISPRTLNAWVKVIEEKAFSPEVIPMFTALSEGATPQDLNTMLNTVGGHQAAMQMLKDTINEEAAEWDRMHPVHAGPNAPGQMREPRGSDIAGTTSTLQEQIGWMTSNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQVTNSAXIMMQRGNFRNQRRIVKCFNCGKEGHIAKNCRAPRKKGCWKCGKEGHQMKDCTERQANFLGKIWPSHKGRPGNFLQSRPEPTAPPEESFRFGEETTTPSQKPEQADKELYPLVSLKSLFGNDPSSQ

SEQ ID NO: 157 - protein, 507 aa, Human immunodeficiency virus
  variant (317)..(317): Xaa can be any naturally occurring amino acid
  variant (386)..(386): Xaa can be any naturally occurring amino acid
MGARASVLSGGELDRWEKIRLRPGGKKKYQLKHIVWASRELERFAVNPGLLETSEGCRQILGQLQPSLQTGSEELRSLYNTIATLYCVHQRIDVKDTKEALEKIEEEQNKSKKKAQQAAANTGNSSQGSQSGSQGSQNYPIVQNIQGQMVHQAISPRTLNAWVKVIEEKAFSPEVIPMFSALSEGATPQDLNTMLNTVGGHQAAMQMLKETINEEAAEWDRLHPVPAGPVAPGQMREPRGSDIAGTTSTLQEQIGWMTNNPPIPVGEIYKRWIILGLNKIVRMYSPVSILDIRQGPKEPFRDYVDRFYKTLRAEQAXQEVKNWMTETLLVQNANPDCKTILKALGPAATLEEMMTACQGVGGPGHKARVLAEAMSQVTNPTTIMMXRGNFRNQRKTIKCFNCGKEGHLARNCRAPRKKGCWKCGKEGHQMKDCTERQANFLGKIWPSHKGRPGNFLQSRPEPTAPPEESFRFGEETTTPSQKQETIDKEMYPITSLKSLFGNDPSSQ

SEQ ID NO: 158 - protein, 504 aa, Human immunodeficiency virus
MGARASVLSGGELDKWEKIRLRPGGKKKYRLKHVVWASRELERFAVNPGLLETSEGCRQILEQLQPSLQTGSEELRSLFNTVAVLYCVHQKIEVKDTKEALDKIEEEQNKSKKKAQQAEADTGNRNQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNPTAIMIQKGNFRNQRRTVKCFNCGKEGHIAKNCRAPRKKGCWKCGKEGHQMKDCTERQANFLGKIWPSHKGRPGNFLQNRPENRPEPTAPPAESFRFGEETMAPSQKQEPTDKELYPLASLRSLFGNDPSSQ

SEQ ID NO: 159 - protein, 500 aa, Human immunodeficiency virus
  variant (161)..(161): Xaa can be any naturally occurring amino acid
  variant (264)..(264): Xaa can be any naturally occurring amino acid
MGARASVLSGEKLGNWERIRLRPGGKKRYRLKHIVWASRELERFAVNPSLLETSEGCRQILGQLQPALQTGSEELKSLYNTVATLYCVHQNIEVRDTKEALDKIEEEQNKCKKKAQQAAAGTGNSSQASQNYPIVQNMQGQMVHQPISPRTLNAWVKVVEXKAFSPEVIPMFTALSEGATPQDLNTMLNTVGGHQAAMQMLKETINEEAAEWDRLHPVHAGPIAPGQMREPRGSDIAGTTSTLQEQIGWMTNNPPIPVGEIYKXWIVMGLNKIVRMYSPTSILDIKQGPKEPFRDYVDRFYKVLRAEQASQDVKNWMTETLLVQNANPDCKTILKALGPAATLEEMMTACQGVGGPGHKARVLAEAMSQVTHPTTIMMQKGNFGNQRKMVKCFNCGKAGHIARNCRAPRKKGCWKCGKEGHQMKDCTERQANFLGKIWPSHKGRPGNFLQNRPEPSAPPEESFRFGEETATPSQKQEPIDKELYPLASLKSLFGNDPSSQ

SEQ ID NO: 160 - protein, 498 aa, Human immunodeficiency virus
MGARASVLSGGKLDQWEKIRLRPGGKKKYKLKHIVWASRELERFAVNPGLLETSEGCRQILGQLQPALQTGSEELKSLYNTVAVLYCVHQRIDVKDTKEALDKIEEEQSKSKKKAQQAAAAADTGNSSQNYPIVQNIQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGDIYKRWIILGLNKIVRMYSPTSILDIKQGPKEPFRDYVDRFYKILRAEQASQEVKNWMAETLLVQNANPDCKTILKALGPAATLEEMMTACQGVGGPGHKARVLAEAMSQVANPPTIMIQKGNFRNQRKIIKCFNCGKEGHLARNCKAPRKRGCWKCGKEGHQMKDCTERQANFLGKIWPSHKGRPGNFLQSRPEPTAPPEESFRFGEETTTPQKQEPIDKELYPLASLRSLFGNDPSST

SEQ ID NO: 161 - protein, 500 aa, Human immunodeficiency virus
MGARASVLSGGKLDRWEKIRLRPMGRKKYKLKHLVWASRELERFAVNPDLLETSEGCKQILRQLQPALQTGSEELRSLYNTVATLYCVHQGIEIKDTKEALEKIEEEQNKSKEKAQQAAADTGKNSTVSQNYPIVQNMQGQMVHQPISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMSACQGVGGPSHKARVLAEAMSQVTNSASIMMQRGNFKNQRKIVKCFNCGKEGHIARNCRAPRKRGCWKCGKEGHQMKDCTERQANFLGKIWPSHKGRPGNFLQSRPEPTAPPEESFRFGEETTTPSQKQEPIDKERYPLTSLRSLFGNDPSSQ

SEQ ID NO: 162 - protein, 510 aa, Human immunodeficiency virus
MGARASVLSGGELDRWEKIRLRPGGKKKYKLKHVVWASRELERFAVNPGLLETAGGCRQILEQLQPSLQTGSEELKSLFNTVAVLYCVHQRIDVKDTKEALDKIEEEQNKSKKKAQQAAADTGNSSHTGNSGQVSQNYPIVQNLQGQMVHQALSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTHNPPIPVGEIYKRWIIMGLNKIVRMYSPTSILDIKQGPKEPFRDYVDRFYKTLRAEQATQEVKNWMTETLLVQNANPDCKTILKALGPGATLEEMMTACQGVGGPAHKARVLAEAMSQVTNSATVMMQKGNFRNQRKTIKCFNCGKEGHIAKNCRAPRKRGCWKCGKEGHQMKDCTERQANFLGKIWPSHKGRPGNFLQSRPESRPEPTAPPEECFRFGEETTAPPQKQEPIDKELYPLASLKSLFGNDPSSQ

SEQ ID NO: 163 - protein, 503 aa, Human immunodeficiency virus
MGARASVLSGGKLDKWEKIRLRPGGKKKYQLKHIVWASRELERFAVNPGLLETSEGCRQILGQLQPSLQTGTEELRSLFNTVATLYCVHQGIEIKDTREALDKVEEEQNKSKKKVQQTADGTGNSSQASQNYPIVRNLQGQLTHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIDWMTNNPPIPVGEIYKRWIIMGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTGSATIMMQKGNIRSQRKTVKCFNCGKEGHIARNCRAPRKRGCWKCGKEGHQMKDCTERQANFLGKIWPSHKGRPGNFLQNRPEPTAPPAPPEESFRFGEETTAPSQKQEPINKELYPLTSLRSLFGNDPSSQ

SEQ ID NO: 164 - protein, 503 aa, Human immunodeficiency virus
MGARASVLSGGELDRWEKIRLRPGGKKTYKLKHIVWASRELERFAVNPGLLETSQGCRQILGQLQPSLPTGSEELRSLYNTIAVLYCVHQRIEVKDTKEALDKIEEEQNKGKKQAQQAAADTGSSSKVSQNYPIVQNIQGQMVHQPISPRTLNAWVKVVEEKAFSPEVIPMFSALSEGATPQDLNTMLNTVGGHQAAMQMLKETINEEAADWDRLHPVHAGPVAPGQMREPRGSDIAGTTSTLQEQIGWMTNNPPIPVGEIYKRWIILGLNKIVRMYSPASILDIRQGPKEPFRDYVDRFYKTLRAEQASQEVKNWMTETLLVQNANPDCKTILKALGPGATLEEMMTACQGVGGPGHKARVLAEAMSQVTNSATIMMQKGNFRNQRKPIKCFNCGKEGHLARNCRAPRKRGCWKCGKEGHQMKDCTERQANFLGKIWPSNKGRPGNFPQGRLTPTAPPAPPEESFRFGEETTNPSQRQEPIDQERYPLTSLRSLFGNDPSSQ

SEQ ID NO: 165 - protein, 501 aa, Human immunodeficiency virus
MGARASVLSGGKLDKWEKIRLRPGGKKQYQLKHIVWASRELERFALNPGLLETSEGCRQILGQLQSSLPTASEELRSLYNTVAVLYCVHQNIEVKDTKEALDKIEEEQNKSKKKAQPATAADTGSSSTVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTGSANVMMQRGNFKNQRKTVKCFNCGREGHIARNCRAPRKKGCWKCGKEGHQMKDCTERQANFLGKIWPSHKGRPGNFLQSRPEPTAPPAESFRFGEETTTPSQKQEPIDKELYPLASLKSLFGNDPSSQ

SEQ ID NO: 166 - protein, 508 aa, Human immunodeficiency virus
MGARASILSGGELDRWEKIRLRPGGKKKYRLKHLVWASRELERFAVNPGLLETAEGCRQILEQLQPSLQTGSEELKSLFNTVAVLFCVQRRIDVKDTKEALDKIEEEQNKSKKKAQQAAAQQAAADTRNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKILRAEQASQEVKNWMTETLLVQNANPDCKTILKALGPAATLEEMMTACQGVGGPGHKARVLAEAMSQVTNSATIMMQRGNFKNQRKTVKCFNCGKEGHIARNCRAPRKKGCWKCGKEGHQMKNCTERQANFLGKIWPSHKGRPGNFLQSRPEPTAPPAPPEESFRFGEETATPPQRQEQRDEEKYPLTSLRSLFGNDPSSQ

SEQ ID NO: 167 - protein, 503 aa, Human immunodeficiency virus
MGARASILSGGKLDRWEKIRLRPGGKKRYKLKHLVWASRELERFAVNPGLLETSEGCKQILAQLQPSLQTGSEELKSLYNTVATLYCVHQNIEIKDTKEALDKIEEEQNKSKKKAQAAQQAAAGTGDSSQVSQNYPIVQNLQGQMVHQAISPRTLNAWVKVVEEKAFSPEVIPMFSALSEGATPQDLNTMLNTVGGHQAAMQMLKETINEEAAEWDRLHPAQAGPIAPGQIREPRGSDIAGTTSTLQEQITWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRSQRKTIKCFNCGKEGHTAKNCRAPRKRGCWKCGKEGHQMKDCTERQANFLGKIWPSHKGRPGNFLQNRPEPTAPPEESFRFGEETTATPPQKQEPIDREVYPLTSLRSLFGNDPSS

SEQ ID NO: 168 - protein, 501 aa, Human immunodeficiency virus
MGARASVLSGGELDKWERIRLRPGGRKQYKLKHIVWASRELERFALNPGLLETSEGCRQLLGQIQPSLQTGSEELRSLYNTIATLYCVHQKIDVKDTKEALDKIEEEQNKCKKKAQQAAADSGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPPQAGPVAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSSAAMMMQRGNFRNSRKPIKCFNCGKEGHIARNCRAPRKKGCWKCGKEGHQMKDCTERQANFLGKIWPSHKGRPGNFLQNRPEPTAPPAESFRFGEETTTPSQKPEPIDRELYPLASLKSLFGNDPSSQ

SEQ ID NO: 169 - protein, 500 aa, Human immunodeficiency virus
MGARASVLSGGQLDKWEKIRLRPGGKKKYRLKHIVWASRELERFAVNPGLLETSEGCRQILGQLQPSLQTGSEELRSLFNTIATLYCVHQGIEVKDTKEALEKIEEEQNKSKKKTQQAAAGAGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVQAGPVAPGQLREPRGSDIAGTTSTLQEQIGWMTHNPPIPVGEIYKRWIIMGLNKVVRMYSPTSILDIRQGPKEPFRDYVDRFYKTLRAEQASQEVKNWMTETLLVQNANPDCKTILKALGPAATLEEMMTACQGVGGPGHKARVLAEAMSQATSSATIMMQKGNFRTQRRIVKCFNCGKEGHIAKNCRAPRKKGCWKCGKEGHQMKDCTERQANFLGKIWSSHKGRPGNFLQNRPEPTAPPEESFRFGEETTTPSQKQEPIDKELYPLVSLKSLFGNDPSSQ

SEQ ID NO: 170 - protein, 501 aa, Human immunodeficiency virus
MGARASVLSGGQLDRWEKIRLRPGGKKKYKLKHIVWASRELERFAVNPGLLETPEGCRQILGQLQPSLQTGSEELKSLYNTVATLYCVHQKIDVKDTKEALEKIEEEQNKSKKKAQQAAADAGNNSQVSQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQATNNSVSIMMQRGNFRNQRKIVKCFNCGKEGHIAKNCRAPRKKGCWKCGREGHQMKDCTERQANFLGKIWPSRKGRPGNFLQSRPEPTAPPEESFRFGEETATPSQKQDPIDKELYPLASLKSLFGNDPSSQ

SEQ ID NO: 171 - protein, 503 aa, Human immunodeficiency virus
MGARASVLSGGELDRWEKIRLRPGGKKRYKLKHIVWASRELERFAVNPGLLETSEGCRQILGQLQPSLQTGSEELKSLFNTVAVLYCVHQRIEVKDTKEALDKIEEEQNKIKKRVQQAAADTGNSNSSQVVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVTNPANIMMQRGNFRNQRKTVKCFNCGKEGHIAKNCRAPRKKGCWKCGKEGHQIKDCTERQANFLGRIWPSNKGRPGNFLQSRPEPTAPPEESFRFGEETATPPQKQEPIDKELYPLASLRSLFGSDPSSQ

SEQ ID NO: 172 - protein, 503 aa, Human immunodeficiency virus
MGARASVLSGGQLDRWEKIRLRPGGKKQYKLKHIVWASRELERFAVNPSLLETSEGCRQILGQLQPSLQTGSEELKSLYNTVAVLYCVHQRIDVKDTKEALEKIEEEQNKIKKRTQQAAADTGNNSPVSQNYPIVQNMQGQMVHQAISPRTLNAWVKVIEEKNFSPEVIPMFSALSEGATPQDLNTMLNTIGGHQAAMQMLKETINDEAAEWDRLHPAQAGPAAPGQVREPRGSDIAGTTSTLQEQIAWMTHNPPIPVGEIYKRWIILGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVQNSNSIMMQRGNFKNQRKSVKCFNCGKEGHIARNCRAPRKKGCWKCGKEGHQMKDCTERQANFLGKIWPSHKGRPGNFLQNRPEPTAPPEPTAPPEESFRFGEETTTPSQKQGPIDKELYPSASLRSLFGNDP

SEQ ID NO: 173 - protein, 500 aa, Human immunodeficiency virus
MGARASVLSGGKLDTWEKIRLRPGGKKKYQLKHIVWASRELERFAVNPGLLETSEGCRQILGVLQPSLQTGSEELRSLYNTVATLYCVHQGIEVRDTKEALEKVEEEQNKKKNAQQAAADTGNSSKPVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARILAEAMSQVTNPTTIMMQRGNFKNQRKIVKCFNCGKEGHIARNCRAPRKKGCWKCGKEGHQMKDCTERQANFLGKIWPSYKGRPGNFLQSRPEPTAPPEESFRFGEETTTPPQKQEPIDKELYPLTSLKSLFGSDPSSQ

SEQ ID NO: 174 - protein, 500 aa, Human immunodeficiency virus
MGARASVLSGGELDRWEKIRLRPGGKKRYKLKHIVWASRELERFAVNPGLLETSEGCRQILGQLQPSLQTGSEELKSLYNTIAVLYCVHQRIEVKDTKEALDKIEEEQNKSKKKAQQAAADTGNSSPVSQNYPIVQNLQGQMVHQTISPRTLNAWVKVIEEKAFSPEVIPMFSALSEGATPQDLNTMLNTVGGHQAAMQMLKETINEEAAEWDRTHPVHAGPIAPGQMREPRGSDIAGTTSTLQEQIGWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNAPNIMMQRGNFRSQRRPVKCFNCGKEGHIAKNCRAPRKKGCWKCGREGHQMKDCTERQANFLGKIWPSHKGRPGNFLQNRPEPTAPPAESFRFGEETTTPPQKQELVDKELYPLASLKSLFGNDPSSQ

SEQ ID NO: 175 - protein, 503 aa, Human immunodeficiency virus
MGARASVLSGGQLDKWEKIRLRPGGKKQYKLKHIVWASRELERFAVNPGLLETAEGCRQILEQLQPALKTGSEELRSLFNTIAVLYCVHQKIEVKDTKEALDKIEEEQNKSKKRVQQAAAAAADTGNKSQVSQNYPIVQNLQGQMVHQALSPRTLNAWVKVVEEKAFSPEVIPMFTALSEGATPQDLNTMLNTVGGHQAAMQMLKETINEEAAEWDRVHPVHAGPVAPGQMREPRGSDIAGTTSNLQEQIAWMTSNPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTNSPTVMMQKGNFRNQRKTVKCFNCGKEGHIAKNCRAPRKKGCWKCGREGHQMKDCTERQANFLGKIWPSHKGRPGNFLQSRPEPTAPPAESFGFGEETTAPPQKQEPIDKELYPLTSLKSLFGNDPSSQ

SEQ ID NO: 176 - protein, 511 aa, Human immunodeficiency virus
MGARASVLSGGELDRWEKIRLRPGGKKKYKLKHIVWASRELERFAVNPGLLETAQGCTQILGQLQPSLQTGSEELKSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFTALSEGATPQDLNTMLNTVGGHQAAMQMLEETINEEAAEWDRLHPVHAGPIAPGQIREPRGSDIAGTTSTLAEQMAWITGNPPVPVGEIYKRWIIMGLNKIVRMYSPTSILDIRQGPKEPFRDYVDRFYKTLRAEQASQEVKNWMTETLLVQNANPDCRTILKALGPAATLEEMMTACQGVGGPGHKARVLAEAMSQVTNTTNIMMQKSNFRGQRKIVKCFNCGKEGHIAKNCRAPRKRGCWKCGKEGHQMKDCTERQANFLGKIWPSYKGRPGNFLQNRPEPTAPPPQSRLEPTAPPEESFRFGEETTALPQRQELIDKEQHHLASLRSLFGNDPLSQ

SEQ ID NO: 177 - protein, 505 aa, Human immunodeficiency virus
MGARASVLSGGKLDQWEKIRLRPGGKKKYHLKHIVWASRELERFAVNPGLLETSEGCRQILRQLQPSLQTGSEEFKSLYNTIAVLYCVHQRIEIKDTKEALDQIEEEQNKSKKKAQQAAAAADTGSGSSPASQNYPIVQNMQGQMVHQPISPRTLNAWVKVVEEKAFSPEVIPMFSALAEGATPQDLNTMLNTVGGHQAAMQMLKETINEEAAEWDRLHPAQAGPVAPGQVREPRGSDIAGTTSTLQEQIAWMTHNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTGSAATVMMQRGNFKNQRKSVKCFNCGKEGHIARNCRAPRKKGCWKCGKEGHQMKDCTERQANFLGKIWPSHKGRPGNFLQSRPEPTAPPAESFRFGEETTTPSQKQELVDKEMYPPLTSLRSLFGNDPSSQ

SEQ ID NO: 178 - protein, 500 aa, Human immunodeficiency virus
MGARASVLSGGELDRWEKIRLRPGGKKQYKLKHIVWASRELERFAVNPGLLETAEGCRKILEQLQPSLQTGSEELQSLHNTIAVLYCVHQRIDVKDTKEALEKIEEEQNKIKKRAQQAAADTKNSSQVSQNYPIVQNLQGQMVHQPISPRTLNAWVKVVEEKAFSPEVIPMFTALSEGATPQDLNTMLNTVGGHQAAMQMLKETINEEAAEWDRLHPVHAGPIAPGQMREPRGSDIAGTTSNLQEQIGWMTSNPPIPVGEIYKRWIILGLNKIVRMYSPTSILDIRQGPKEPFRDYVDRFYKTLRAEQASQDVKNWMTETLLVQNANPDCRTILKALGPAATLEEMMTACQGVGGPGHKARVLAEAMSQVTNSATVMMQRGNFRNQRKIVKCFNCGKEGHIARNCRAPRKKGCWKCGQEGHQMKDCTGRQANFLGKIWPSNKGRPGNFLQSRPEPSAPPEESFRFAEETATPPQKREPIDKELYPLASLKSLFGNDPSSQ

SEQ ID NO: 179 - protein, 501 aa, Human immunodeficiency virus
MGARASVLSGGKLDKWERIRLRPGGKKKYRLKHIVWASRELERFAVNPGLLETAEGCRQTLGALQPSLQTGSEELRSLYNTVAVLYCVHQNIEIRDTKEALDRVEEEQNKSKKRTQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSQTTSTNIMMQRGNFRNQRKPVKCFNCGKEGHIAKNCRAPRKKGCWKCGQEGHQMKDCTERQANFLGKIWPSSKGRPGNFLQSRPEPTAPPEESFRFGEETMAAAPSQKQEPKDKELYPLASLKSLFGNDPLSQ

SEQ ID NO: 180 - protein, 501 aa, Human immunodeficiency virus
MGARASVLSGGKLDKWERIRLRPGGNKRYKLKHIVWASRELERFAVNPGLLETAEGCRQILGQLHPSLQTGSEELRSLYNTIATLYCVHQQIDVKDTKEALDKIEEEQNKSKNKAQQAAADTGSSSQNYPIVQNLQGQMVHQALSPRTLNAWVKVIEEKAFSPEVIPMFSALSEGATPQDLNTMLNTVGGHQAAMQMLKETINEEAAEWDRVHPVHAGPIAPGQLREPRGSDIAGTTSNLQEQIAWMTHNPPIPVGEIYKRWIILGLNKIVRMYSPVSILDIRQGPKEPFRDYVDRFYKTLRAEQATQEVKNWMTETLLVQNANPDCKTILKALGPGATLEEMMTACQGVGGPAHKARVLAEAMSQATGAAANIMMQKGNFRNQRRTVKCFNCGKEGHIAKNCRAPRKKGCWKCGEEGHQMKNCPGRQANFLGKVWPSHKGRPGNFLQSRPEPTAPSAPPAESFRFGEEMTAPSQKQETPKEELYPLASLKSLFGNDPSSQ

SEQ ID NO: 181 - protein, 500 aa, Human immunodeficiency virus
MGARASVLSGGELDRWEKIRLRPGGKKKYRLKHLVWASRELERFAVNPGLLETSEGCKQILGQLQPSLQTGSEELKSLYNAVAVLYCVHQRIDIKDTKEALEKIEEEQNKSKKKTQQAAADTGSSSQVSHNFPIVQNLQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIAWMTNNPPIPVGEIYKKWIIMGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSQTTNTTAMMMQRGNFKNQRKPVKCFNCGKEGHLARNCRAPRKKGCWKCGKEGHQMKDCTERQANFLGKIWPSYKGRPGNFLQSRPEPTAPPEESFRFGEEVATPVQKQEPIDKEMYPLTSLKSLFGNDPSSQ

SEQ ID NO: 182 - protein, 500 aa, Human immunodeficiency virus
MGARASVLSGGELDRWEKIRLRPGGKKKYKLKHIVWASRELERFAVNPGLLETSEGCKQILGELQPSLQTGSEELRSLFNTVAVLYCVHQRIAVKDTKEALEKIEEEQNKSKKKAQQAAADPGKNSQVSQNYPIVQNLQGQMVHQAISPRTLNAWVKVVEEKAFSPEVIPMFSALSEGATPQDLNTMLNTVGGHQAAMQMLKETINEEAAEWDRMHPVQAGPVAPGQMREPRGSDIAGTTSNLQEQIAWMTSNPPVPVGEIYKRWIIMGLNKIVRMYSPTSILDIRQGPKEPFRDYVDRFYKTLRAEQASQEVKHWMTETLLVQNANPDCKTILKALGPAATLEEMMTACQGVGGPGHKARVLAEAMSQVTNQNTIMMQRGNFRNQRKIIKCFNCGKEGHVARNCRAPRKKGCWKCGKEGHQMKDCTERQANFLGKIWPSHKGRPGNFLQSRPEPTAPPAESFRVGEETATPSQKQEPTDKELYPLTSLKSLFGSDPSSQ

SEQ ID NO: 183 - protein, 504 aa, Human immunodeficiency virus
  variant (28)..(28): Xaa can be any naturally occurring amino acid
  variant (48)..(48): Xaa can be any naturally occurring amino acid
  variant (102)..(102): Xaa can be any naturally occurring amino acid
  variant (130)..(130): Xaa can be any naturally occurring amino acid
  variant (313)..(313): Xaa can be any naturally occurring amino acid
  variant (372)..(372): Xaa can be any naturally occurring amino acid
  variant (390)..(390): Xaa can be any naturally occurring amino acid
  variant (431)..(431): Xaa can be any naturally occurring amino acid
  variant (471)..(471): Xaa can be any naturally occurring amino acid
  variant (482)..(482): Xaa can be any naturally occurring amino acid
  variant (486)..(487): Xaa can be any naturally occurring amino acid
MGARASILSGGGLDRWEKIRLRPGGKKXYRLKHIVWASRELERFAVNXSLLETSEGCRQILGQLHPSLQTGSEELKSLYNTIAVLYCVHQRIDIKDTKEALXKIEEEQNKSKKKAQQAAADTGNSNGNSXQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIAWITNNPPIPVGEIYKRWIILGLNKIVRMYSPTSILDIRQGPKEPFRDYVDRFYKTLRAEQXSQEVKNWMTETLLVQNANPDCKTILKALGPGATLEEMMTACQGVGGPGHKARVLAEAMXQMTSSATIMMQRGNFRNXRRTVKCFNCGKEGHIAKNCRAPRKKGCWKCGKEGHQMKDCXERQANFLGKIWPSHKGRPGNFLQSRPEPTAPPEESFRFGXEKTTPSQKQEXIDKXXYPLASLKSLFGNDPSSQ

SEQ ID NO: 184 - protein, 499 aa, Human immunodeficiency virus
  variant (325)..(325): Xaa can be any naturally occurring amino acid
MGARASVLSGGELDRWEKIRLRPGGKKKYRLKHIVWASRELERFAVNPGLLETSGGCRQILEQLQPSLQTGSEELKSLYNTVATLYCVHRKIDVRDTKEALEKVEEEQNKSKKAQQAAADTGNNRQVSQNYPIVQNLQGQMVHQPISPRTLNAWVKVVEEKAFSPEVIPMFSALAEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNXNPDCKTILKALGPAATLEEMMTACQGVGGPGHKARVLAEAMSQVTNSATIMMQRGNFKNQRKIVKCFNCGKEGHIARNCRAPRKKGCWKCGKEGHQMKDCMERQANFLGKIWPSHKGRPGNFLQNRPEPTAPPEESFRFGEETTTPPQKQEPIDKEQYPLTALRSLFGSDPSSQ

SEQ ID NO: 185 - protein, 500 aa, Human immunodeficiency virus
  variant (11)..(11): Xaa can be any naturally occurring amino acid
  variant (23)..(23): Xaa can be any naturally occurring amino acid
  variant (69)..(69): Xaa can be any naturally occurring amino acid
  variant (76)..(76): Xaa can be any naturally occurring amino acid
  variant (79)..(79): Xaa can be any naturally occurring amino acid
  variant (86)..(86): Xaa can be any naturally occurring amino acid
  variant (95)..(95): Xaa can be any naturally occurring amino acid
  variant (114)..(114): Xaa can be any naturally occurring amino acid
  variant (373)..(373): Xaa can be any naturally occurring amino acid
  variant (375)..(375): Xaa can be any naturally occurring amino acid
  variant (383)..(383): Xaa can be any naturally occurring amino acid
  variant (474)..(474): Xaa can be any naturally occurring amino acid
MGARASVLSGXKLDKWEKIRLRXGGKKKYRLKHIVWASRELERFAVNPGLLETSEGCKQILIQLQPSLXTGSEELXSLXNTIATLXCVHQNIEVXDTKEALERIEEEQNKSKTXAQQAAANTGNSSQVSQNYPIVQNLQGQMVHQPLSPRTLNAWVKVVEEKNFSPEVIPMFTALSEGATPQDLNTMLNTIGGHQAAMQMLKETINEEAAEWDRLHPVHAGPIAPGQMREPRGSDIAGTTSSLQEQIAWMTSNPPIPVGEIYKRWIILGLNKIVRMYSPISILDIRQGPKEPFRDYVDRFYKTLRAEQASQDVKNWMTETLLVQNANPDCKTILKALGPAATLEEMMTACQGVGGPGHKARVLAEAMSQVTNXTXVMMQRGNXRNQRKIIKCFNCGKEGHLARNCRAPRKKGCWKCGQEGHQMKDCTERQANFLGKIWPSHKGRPGNFLQSRPEPTAPPEESFRFGEETTTPSXKQEQIDKDLYPLASLKSLFGNDPSSQ

SEQ ID NO: 186 - protein, 499 aa, Human immunodeficiency virus
  variant (114)..(114): Xaa can be any naturally occurring amino acid
  variant (125)..(125): Xaa can be any naturally occurring amino acid
  variant (400)..(400): Xaa can be any naturally occurring amino acid
  variant (408)..(408): Xaa can be any naturally occurring amino acid
  variant (418)..(418): Xaa can be any naturally occurring amino acid
  variant (434)..(434): Xaa can be any naturally occurring amino acid
MGARASVLSGGELDKWEKIRLRPGGKKKYRLKHIVWASRELERFAVNPGLMETAEGCRQILGQLQPSLQTGSEELKSLYNTLAVLYCVHQKIEIKDTKEALDKIEEEQNKSKKXAQQAAADTGNXSQVSQNYPIVQNLQGQMVHQALSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILEIRQGPKEPFRDYVDRFYKTLRAEQASQDVKNWMTETLLVQNANPDCKTILKALGPAATLEEMMTACQGVGGPGHKARVLAEAMSQVTSSANIMMQRGNFRNRKPVKCFNCGKEGHXAKNCRAPXKRGCWKCGKXGHQMKDCTERQANFLXKIWPSHKGRPGNFLQNRPEPTAPPEESFRFGEETTTCSQKQEQIDKEMYPLTSLKSLFGNDPSSQ

SEQ ID NO: 187 - protein, 499 aa, Human immunodeficiency virus
  variant (271)..(271): Xaa can be any naturally occurring amino acid
  variant (356)..(356): Xaa can be any naturally occurring amino acid
MGARASVLSGGQLDRWEKIRLRPGGKKKYKLKHLVWASRELERFAVNPGLLESSEGCKQILAQLQPSLQTGSEELKSLFNTVSVLYCVHQRIDVKDTKEALEKIEEEQNKSKKKAQQAAADTGNSSSQVSQNYPIVQNLQGQMVHQPLSPRTLNAWVKVIEEKAFSPEVIPMFSALSEGATPQDLNTMLNTVGGHQAAMQMLKDTINEEAAEWDRLHPVQAGPIAPGQIREPRGSDIAGTTSNLQEQIAWMTRNPPIPVGDIYKRWIILGXNKIVRMYSPVSILDIRQGPKEPFRDYVDRFYKTLRAEQCTQDVKNWMTETLLVQNANPDCKTILKALGPAATLEEMMTACQGVGXPSHKARVLAEAMSKANSTTIMVQRGQFKNQRKIVKCFNCGKEGHIARNCRAPRKKGCWKCGQEGHQMKDCTERQANFLGKIWPSHKGRPGNFLQSRPEPTAPPVESFGFGEETATPPQKQEPDKDLYPLASLKSLFGNDPLSQ

SEQ ID NO: 188 - protein, 500 aa, Human immunodeficiency virus
  variant (15)..(15): Xaa can be any naturally occurring amino acid
  variant (190)..(190): Xaa can be any naturally occurring amino acid
  variant (216)..(216): Xaa can be any naturally occurring amino acid
  variant (269)..(269): Xaa can be any naturally occurring amino acid
MGARASVLSGGKLDXWEKIRLRPGGKKQYKLKHLVWASRELERFAVNPGLLETSDGCRQILGQLQPALKTGSEELKSLYNTVATLYCVHQNIEVRDTKEALDKIEEEQNKSKKKAQQAAADTGNGSQVSQNYPIVQNLQGQMVHQPISPRTLNAWVKVIEEKAFSPEVIPMFSALSEGATPQDLNTMLNXVGGHQAAMQMLKETINEEAAEWDRLXPAQAGPVAPGQMREPRGSDIAGTTSTLQEQIAWTTGNPAIPVGEIYKRWIILXLNKIVRMYSPISILDIRQGPKEPFRDYVDRFYKTLRAEQASQEVKNWMTETLLVQNANPDCKTILKALGPAATLEEMMTACQGVGGPGHKARVLAEAMSHLTNSAVMMQRGNFKNQRKTIKCFNCGKDGHLARNCRAPRKKGCWKCGKEGHQMKDCDERQANFLGKIWPSHKGRPGNFLQSRPEPTAPPAESFRFGEETATPPQKQEPIDKEPLYPSASLKSLFGNDPLLQ

SEQ ID NO: 189 - protein, 500 aa, Human immunodeficiency virus
MGARASILSGGALDRWEKIRLRPGGRKRYKLKHLVWASRELERFAVNPGLLETSEGCKQILGQLQPSLQTGSEELKSLFNTVAVLYCVHQRIEVKDTKEALEKIEEEQNKSKKKAQQAAADTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTHNPPIPVGEIYKRWIILGLNKIVRMYSPASILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKTVKCFNCGKEGHIARNCRAPRKRGCWKCGKDGHQMKDCTERQANFLGKIWPSHKGRPGNFLQSRPEPTAPPEESIRFGEETTTPSQKQEQIDKEKYPLTSLRSLFGNDPSSQ

SEQ ID NO: 190 - protein, 500 aa, Human immunodeficiency virus
  variant (58)..(58): Xaa can be any naturally occurring amino acid
  variant (63)..(63): Xaa can be any naturally occurring amino acid
  variant (79)..(79): Xaa can be any naturally occurring amino acid
  variant (82)..(82): Xaa can be any naturally occurring amino acid
  variant (90)..(90): Xaa can be any naturally occurring amino acid
  variant (94)..(94): Xaa can be any naturally occurring amino acid
  variant (122)..(122): Xaa can be any naturally occurring amino acid
  variant (216)..(216): Xaa can be any naturally occurring amino acid
  variant (268)..(268): Xaa can be any naturally occurring amino acid
  variant (292)..(292): Xaa can be any naturally occurring amino acid
  variant (307)..(307): Xaa can be any naturally occurring amino acid
  variant (384)..(384): Xaa can be any naturally occurring amino acid
  variant (389)..(389): Xaa can be any naturally occurring amino acid
  variant (409)..(409): Xaa can be any naturally occurring amino acid
  variant (462)..(462): Xaa can be any naturally occurring amino acid
  variant (486)..(486): Xaa can be any naturally occurring amino acid
  variant (488)..(488): Xaa can be any naturally occurring amino acid
MGARASVLSGGELDKWEKIRLRPGGKKKYKLKHIVWASRELERFAVNPGLLETSEGCXQILGXLQPSLQAGSEELKSLXNTXAVLYCVHXRIEXKDTKEALDKIEEEQNKSKKQAQQAAADXGNSSQVSQNYPIVQNLQGQMVHQPLSPRTLNAWVKVVEEKAFSPEVIPMFSALSEGATPQDLNTMLNTVGGHQAAMQMLKETINEEAADWDRLXPVHAGPIAPGQMREPRGSDIAGTTSTLQEQIGWMTNNPPIPVGEIYKRWIIXGLNKIVRMYSPTSILDIKQGPKEXFRDYVDRFYKTLRAXQASQEVKNWMTETLLVQNANPDCKTILKALGPAATLEEMMTACQGVGGPGHKARVLAEAMSQVTNPNTIMMQRGNFXNQRKXVKCFNCGKEGHIAKNCRAPXKRGCWKCGKEGHQMKDCTERQANFLGKIWPSHKGRPGNFLQSRPEPTAPPEEXFRFGEETATPPQKQEQTDKELYPXTXLRSLFGNDPLSQ

SEQ ID NO: 191 - protein, 503 aa, Human immunodeficiency virus
  variant (207)..(207): Xaa can be any naturally occurring amino acid
MGARASVLSGGQLDRWEKIRLRPGGKKKYKLKHIVWASRELERFAVNPGLLESPEGCRQILGQLQPSLQTGSEELRSLYNTVATLYCVHQQIEVKDTKEALEKIEEEQNKSKKKAPQAQAAAADTGNRSQVSQNYPIVQNLQGQMVHQALSPRTLNAWVKVVEEKAFSPEVIPMFSALSEGATPQDLNTMLNTVGGHQAAMQMLKEXINEEAAEWDRMHPVHAGPIAPGQMREPRGSDIAGTTSTLQEQIGWMTNNPPIPVGEIYKRWIILGLNKIVRMYSPTSILDIRQGPKESFRDYVDRFYKTLRAEQASQEVKNWMTETLLVQNANPDCKTILKALGPGATLEEMMTACQGVGGPSHKARVLAEAMSQVTSPATVMMQRGNFRNQRKPVKCFNCGKDGHIARNCKAPRKKGCWKCGKEGHQMKDCPNRQANFLGKIWPSHKGRPGNFLQSRPEPTAPPEESFRFGEGTTTPPQKQELIDKDLYPSASLKSLFGNDPLLQ

SEQ ID NO: 192 - protein, 500 aa, Human immunodeficiency virus
MGARASVLSGGELDRWEKIRLRPGGKKRYKLKHIVWASRELERFAVNPGLLETSEGCRQILGQLQPALQTGSEELKSLFNTVATLYCVHQRIEIKDTKEALDKIEEEQNKSKKKAQQAAADTGSSSQSSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVTNSTAIMMQRGNSRPQRKIVKCFNCGKEGHIARNCRAPRKRGCWKCGKEGHQMKDCTERQANFLGKIWPSHKGRPGNFIQNRLEPTAPPEEIFRFGEETTTPPQKQEPRDKEQYPLTSLRSLFGNDPSSQ

SEQ ID NO: 193 - protein, 507 aa, Human immunodeficiency virus
  variant (166)..(166): Xaa can be any naturally occurring amino acid
  variant (325)..(325): Xaa can be any naturally occurring amino acid
MGARASVLSAGELDKWEKIRLRPGGKKKYRLKHIVWASRELERFAVNPGLLETSEGCRQILGQLQPSLQTGSEELRSLFNTVATLYCVHQKIDVKDTKEALEKVEEEQNKSKKKTQQAAAGAGNSSQVSQVSQNYPIVQNLQGQMVHQAISPRTLNAWVKVVEEKXFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLXVQNANPDCKTILKALGPAATLEEMMTACQGVGGPGHKARVLAEAMSQVTGPAAVMMQRGNFRNQRKTVKCFNCGKEGHIAKNCRAPRKKGCWKCGKEGHQMKDCTERQANFLGKIWPSHKGRPGNFLQSRPEPTAPPAPPEEIFRFGEETTNPSQKQETMEKELYPPLASLKSLFGNDPSSQ

SEQ ID NO: 194 - protein, 503 aa, Human immunodeficiency virus
  variant (493)..(493): Xaa can be any naturally occurring amino acid
MGARASVLSGGELDRWEKIRLRPGGKKKYRLKHLVWVSRELERFAVNPGLLETSEGCRQIIEQLPPSLPTGSEELRSVYNAVATLYCVHQRIDVKDTKEALDKIEEEQNKSKKKAQQAQQAAADTGNSRQVSQNFPIVQNLQGQMVHQPISPRTLNAWVKVIEEKAFSPEIIPMFSALSEGATPQDLNTMLNTVGGHQAAMQMLKETINEEAAEWDRVHPVHAGPVAPGQMREPRGSDIAGTTSTLQEQIGWMTHNPPIPVGDIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSATIMMQRGNVRNQRRIIKCFNCGKEGHIAKNCRAPRKKGCWKCGKEGHQMKDCTERQANFLGKIWPSHKGRPGNFLQSRPEPTAPPEESFRFGEETAAPSQKQETIDKEMYPITSLXSLFGNDPSSQ

SEQ ID NO: 195 - protein, 497 aa, Human immunodeficiency virus
MGARASVLSGGKLDRWEKIRLRPGGKKKYRLKHIVWASRELERFAVNPGLLETSGGCKQILNQLQPSLQTGSEELRSLYNTVATLYCVHQKIDVKDTKEALDKIEEEQNESKKKTQQAAAGTSQVSQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPSSILDIKQGPKEPFRDYVDRFYKTLRAEQASQEVKNWMTETLLVQNANPDCKTILKALGPAATLEEMMTACQGVGGPAHKARVLAEAMSQVTNPATTMMQRGNFRNQRRVIKCFNCGKEGHIAKNCRAPRKKGCWKCGQEGHQMKDCTERQANFLGKIWPSHKGRPGNFLQSRPEPTAPPAESFRFGEEITTPSQKQEPIDKELYPLASLRSLFGNDPSSQ

SEQ ID NO: 196 - protein, 503 aa, Human immunodeficiency virus
  variant (91)..(91): Xaa can be any naturally occurring amino acid
  variant (125)..(125): Xaa can be any naturally occurring amino acid
  variant (127)..(127): Xaa can be any naturally occurring amino acid
  variant (130)..(130): Xaa can be any naturally occurring amino acid
MGARASVLSGGKLDKWEKIRLRPGGKKKYQLKHIVWASRELERFAVNPGLLETSDGCRQILLQLQPSLQTGSEELKSLFNTVAVLYCVHQXIEVKDTKEALDKIEEEQNKSKKKAQAQQAAADTXNXSQXSQNYPIVQNLQGQMVHQPISPRTLNAWVKVVEEKAFSPEVIPMFTALSEGATPQDLNTMLNTVGGHQAAMQMLKETINEEAAEWDRLHPPQAGPIAPGQIREPRGSDIAGTTSTLQEQITWMTNNPPIPVGEIYKRWIILGLNKIVRMYSPTSILDIRQGPKEPFRDYVDRFYKTLRAEQASQDVKNWMTETLLVQNANPDCKTILKALGPGASLEEMMTACQGVGGPGHKARVLAEAMSQMTGAANSIMMQRGNFKNNRKTVKCFNCGKEGHIARNCRAPRKKGCWKCGKEGHQMKDCTERQANFLGKIWPSHKGRPGNFLQSRPEPSAPPEESFRFGEETTTPCQKQEPKDKELYPLASLKSLFGNDPSSQ

SEQ ID NO: 197 - protein, 506 aa, Human immunodeficiency virus
MGARASVLSGGQLDKWEKIRLRPGGKKKYKLKHLVWASRELERFAVNPGLLETSDGCRQILGQLQPALQTGSEELRSLYNTVATLYCVHQGIGVRDTKEAIEKVEEEQNKSKKKAQQAAAAADTGNSSQVSQNYPIVQNLQGQMVHQALSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLIQNSNPDCKTILKALGQGATLEEMMTACQGVGGPGHKARVLAEAMSQVTTPPNAIMMQRGNFRNQRKTVKCFNCGKEGHIARNCRAPRKKGCWKCGREGHQMKDCTERQANFLGKIWPSHKGRPGNFLQNRPEPTAPTAPPEESFRFGEETTTHSQKQETIDKEMYPLASLKSLFGNDPSSQ

SEQ ID NO: 198 - protein, 504 aa, Human immunodeficiency virus
MGARASVLSGGELDRWEKIRLRPGGKKKYKLKHIVWASRELERFAVNPGLLETSEGCRQILGQLHPSLQTGSEELKSLYNTVATLYCVHQKIDVKDTKEALDKVEEEQNKSKKKAQPAAAAASAGSNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQATNSVNIMMQRGNFRSPKRIVKCFNCGKEGHIAKNCRAPRKKGCWKCGKEGHQMKDCTERQANFLGKIWPSHKGRPGNFLQSRPEPTAPPAESFKFGEETTTPSQKQEIIDRDKELYPLASLRSLFGSDPSSQ

SEQ ID NO: 199 - protein, 503 aa, Human immunodeficiency virus
  variant (165)..(165): Xaa can be any naturally occurring amino acid
  variant (232)..(232): Xaa can be any naturally occurring amino acid
  variant (264)..(264): Xaa can be any naturally occurring amino acid
  variant (310)..(310): Xaa can be any naturally occurring amino acid
  variant (373)..(373): Xaa can be any naturally occurring amino acid
  variant (479)..(479): Xaa can be any naturally occurring amino acid
  variant (482)..(482): Xaa can be any naturally occurring amino acid
  variant (486)..(486): Xaa can be any naturally occurring amino acid
  variant (501)..(501): Xaa can be any naturally occurring amino acid
MGARASVLSGGELDRWEKIRLRPGGKKKYKLKHIVWASRELERFAVNPGLLETSAGCRQILGQLQPSLQTGSEELKSLYNTVATLYCVHQKIDVKDTKEALDKIEEEQNKSKKKAQQAAADTGNSSSQVSQNYPIVQNMQGQMVHQPLSPRTLNAWVKVVEEKNXSPEVIPMFTALSEGATPQDLNTMLNTIGGHQAAMQMLKETINEEAAEWDRLHPVHAGPIAPGQMREXRGSDIAGTTSTLQEQIGWMTNNPPIPVGEIYXRWIVLGLNKIVRMYSPTSILDIKQGPKEPFRDYVDRFYKTLRAEQXSQEVKGWMTETLLVQNANPDCKTILKAMGPATLEEMMTACQGVGGPGHKARVLAEAMSQVTSXANIMMQRSNFRNQRKIVKCFNCGKEGHIARNCKAPRKRGCWKCGQEGHQMKDCTERQANFLGKIWPSHKGRPGNFLQSRPEPTAPPAPPEESFRFGEGTTTPPQKXEQXDKEXYPLASLKSLFGNDPXSQ

SEQ ID NO: 200 - protein, 500 aa, Human immunodeficiency virus
  variant (116)..(116): Xaa can be any naturally occurring amino acid
  variant (298)..(298): Xaa can be any naturally occurring amino acid
  variant (407)..(407): Xaa can be any naturally occurring amino acid
  variant (477)..(477): Xaa can be any naturally occurring amino acid
MGARASVLSGGELDKWEKIRLRPGGRKKYRLKHIVWASRELERFAVNPGLLESAQGCRQILGQLQPSLQTGSEELRSLFNTVATLYCVHQRIDIKDTKEALEKIEEEQTKSKKKAXQAAADTGNSSQVSQNYPIVQNLQGQAVHQAISPRTLNAWVKVVEEKAFSPEVIPMFSALSEGATPQDLNTMLNTVGGHQAAMQMLKDTINEEAAEWDRLHPVHAGPIAPGQMREPRGSDIAGTTSTLQEQIDWMTHNPPIPVGEIYKRWIILGLNKIVRMYSPVSILDIKQGPKEPFRDYVXRFYKTLRAEQGSQDVKNWMTETLLVQNANPDCKTILRALGPGAQLEEMMTACQGVGGPGHKARVLAEAMSQVSNSATIMMQKGNFRNQRKIVKCFNCGKNGHIARNCRXPRKKGCWKCGKEGHQMKDCDERQANFLGKIWPSYKGRPGNFLQSRPEPTAPPAESFGFGEETATPSQKQXSIDKDLYPLTSLKSLFGNDPSSQ

SEQ ID NO: 201 - protein, 502 aa, Human immunodeficiency virus
  variant (163)..(163): Xaa can be any naturally occurring amino acid
  variant (448)..(448): Xaa can be any naturally occurring amino acid
MGARASVLSGGELDKWEKIRLRPGGKKRYKLKHIVWASRELERFAVNPGLLETSEGCRQILEQLQPALKTGSEELRSLFNTVAVLYCVHQRIEVKDTKEALDKIEEEQNKSKKKAQQAAADTGNSSTSTVSQNYPIVQNLQGQMVHQALSPRTLNAWVKVVEXKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPTSILDIRQGPKEPFRDYVDRFYRTLRAEQASQEVKNWMTETLLVQNANPDCKTILKALGPGATLEEMMTACQGVGGPGHKARVLAEAMSQMTQPATIMMQRGNFRNQRKSVKCFNCGKEGHIARNCRAPRKKGCWKCGKEGHQMKDCTERQANFLGKIWPSHKGRPXNFPQGRLEPTAPPEEGFRMGEETTTPPQKQGSMNKELNPLVSLKSLFGNDPSSQ

SEQ ID NO: 202 - protein, 509 aa, Human immunodeficiency virus
MGARASVLSGGELDKWEKIRLRPGGKKKYKLKHIVWASRELERFAVNPGLLETSQGCRQILEQLQPSLQTGSEELRSLFNTVATLWCVHQKIEVKDTKEALDKLEEEQNKSKKKAQQAAAAQQAAAGTGNNSQVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPVSILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGNFNYQRKPIKCFNCGKAGHIAKHCKAPRKKGCWKCGKEGHQMKDCNERQANFLGKIWPSHKGRPGNFLQNRPEPSAPPEEIFRFGEETTPSQKQETRDRDRDKELYPSASLKSLFGNDPLLQ

SEQ ID NO: 203 - protein, 503 aa, Human immunodeficiency virus
MGARASVLSGGKLDKWEGIRLRPGGNKKYKLKHIVWASRELERFAVNPGLLETSEGCRQILGQLQPSLQTGSEELKSLYNTIAVLYCVHQRIDVKDTKEALDKIEEEQNKSKKKAQPAAADTGNSSSSQVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSNLQEQINWMTGNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVNQTNIMMQRGNFRNQRKTIKCFNCGKEGHLARNCRAPRKKGCWKCGKEGHQMKDCTERQANFLGKIWPSHKGRPGNFLQSRPEPTAPPEESFRFGEETTTPSQKQEPRDRDKELYPLTSLRSLFGNDPSSQ

SEQ ID NO: 204 - protein, 499 aa, Human immunodeficiency virus
MGARASVLSGGKLDKWEKIRLRPGGKKQYKLKHIVWASRELERFAVNPGLLETAGGCKQILEQLQPSLQTGSEELKSLFNTVAVLYCVHKDIEIKDTKEALDKIEEEQNKSKKKAQQAAADTGSNSQVSQNYPIVQNHQGQMVHQAISPRTLNAWVKVVEEKAFSPEVIPMFSALSEGATPQDLNTMLNTVGGHQAAMQMLKETINEEAAEWDRMHPVQAGPIAPGQLREPRGSDIAGTTSTLQEQVAWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTTPGTIMMQKGNFRNQKKSVKCFNCGKEGHIARNCRAPRKKGCWKCGKEGHQMKDCIERQANFLGKIWPSHKGRPGNFLQSTPEPTAPPEESFRFVEEKNPSQKQEQIDKELYPSASLRSLFGNDPSSQ

SEQ ID NO: 205 - protein, 499 aa, Human immunodeficiency virus
MGARASVLSGGELDKWEKIRLRPGGRKQYKLKHIVWASRELERFAVNPGLLETSEGCRQIMGQLQPALQTGSEELRSLYNTVAVLYCVHQRIDVKDTKEALDKIEEEQNKCKKKAQQAAADTGNSNQVSQNYPIVQNIQGQMVHQAISPRTLNAWVKVIEEKAFSPEVIPMFSALSEGATPQDLNTMLNTVGGHQAAMQMLKDTINEEAAEWDRLHPVQAGPVAPGQMRDPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKSILKALGPAATLEEMMIACQGVGGPGHKARVLAEAMSQVTGSANIMMQRGNFRNQRKIVKCFNCGKEGHIARNCRAPRKKGCWKCGKEGHQMKDCTERQANFLGKIWPSHKGRPGNFLQSRPEPTAPPEESFRFGEETTPPQKQETTDKELYPLASLRSLFGNDPSSQ

SEQ ID NO: 206 - protein, 503 aa, Human immunodeficiency virus
MGARASVISGAELDRWEKIRLRPGGSKKYKLKHIVWASRELERFAVNPGLLETSEGCRQILVQLQPSLQTGSEELKSLYNTVVTLYCVHRRIDVKDTKEALEKVEEEQNKSKKNAQQVQQAAAGTGNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPAAPGQMREPRGSDIAGSTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSQATQSNAIMMQRGNFKNQRKIVKCFNCGKEGHIARNCRAPRKKGCWKCGREGHQMKDCTERQANFLGKIWPSNKGRPGNFLQSRPEPTAPPAPPEESFRFGEEKTAPVQKQEPIDKELYPLASLKSLFGNDP

SEQ ID NO: 207 - protein, 502 aa, Human immunodeficiency virus
MGARASILSGGELDRWEKIRLRPGGKKQYKLKHIVWASRELERFAVNPSLLETSEGCRQILGQLQPSLQTGSEELKSLYNTVAVLYCVHQRIEVKDTKEALDKIEEEQNKSKKKAQQAAAATGTSSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGSTSTLQEQVGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVNPNAIMMQRGNFRNQKRTIKCFNCGKEGHLARNCRAPRKKGCWKCGKEGHQMKECTERQANFLGKIWPSSKGRPGNFLQNRPEPTAPPAPPEESFRFGEGTTTPPQKQEPKDKELYPVTSLRSLFGNDPSSQ

SEQ ID NO: 208 - protein, 501 aa, Human immunodeficiency virus
MGARASVLSGGALDRWEKIRLRPGGKKKYKLKHIVWASRELERFAVNPGLLETSEGCKQIIRQLQPSLQTGSEELKSLYNTIAVLYCVHQKIEIKDTKEALEKIEEEQNKCKKKAQQAAADTGNSSQVSQNYPIVQNMQGQMVHQAISPRTLNAWVKVIKEKAFSPEIIPMFSALSEGATPQDLNTMLNTVGGHQAAMQMLKETINEEAADWDRVHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPGATLEEMMTACQGVGGPGHKARVLAEAMSQIATPPAIMMQRGNFKNQRKVVKCFNCGKEGHIAKHCRAPRKRGCWKCGKEGHQMKDCTERQANFLGKIWPSSKGRPGNFLQSRPEPSAPPEESFRFGEETATPPQKQEPPVDKELYPLASLRSLFGNDPSSQ

SEQ ID NO: 209 - protein, 500 aa, Human immunodeficiency virus
MGARASVLSGGKLDRWEKIRLRPLGRKKYRLKHIVWASRELERFAVNPGLLETAEGCRQILGQLHPSLQTGSEELRSLYNTIVVLYCVHQGIEVKDTKEALEKVEEEQNKSKEKAQQAAADTRNKSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGDIYKRWIIMGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNPTNIMMQKGNFRNQRKTVKCFNCGKEGHIARNCRAPRKKGCWKCGKEGHQMKECTERQANFLGKIWPSHKGRPGNFLQSRPEPTAPPAESFRFGEETATPPQKQEPIDKEMYPLASLKSLFGNDPSSQ

SEQ ID NO: 210 - protein, 500 aa, Human immunodeficiency virus
MGARASVLSGGELDRWERIRLRPGGKKTYKLKHIVWASRELERFAVNPGLLETSDGCKQILAQLQPALQTGSEELKSLYNAVAVLYCVHRKIDVRDTKEALDKIEEEQNKSKKKVQQAAADTGNSSQVSQNYPIVRNLQGQMVHQPITPRTLNAWVKVVEEKAFSPEVIPMFSALSEGATPQDLNTMLNTVGGHQAAMQMLKETINEEAAEWDRMHPVHAGPIAPGQMREPRGSDIAGTTSTLQEQIDWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNQGTIMMQRGNFRNQRKIIKCFNCGKEGHIAKHCKAPRKKGCWKCGREGHQMKDCTERQANFLGKIWPSSKGRPGNFLQNRPEPTAPPEESFGFGEETTTPSQKQGTIDKELYPLASLRSLFGNDPSSQ

SEQ ID NO: 211 - protein, 501 aa, Human immunodeficiency virus
MGARASVLSGGELDRWERIRLRPGGKKKYKLKHIVWASRELERFAVNPGLLETTEGCRQILGQLQPSLQTGSEELKSLYNTVAVLYCVHQRIEIKDTKEALEKIEEEQNKSKKKAQQAAAAADTGSNSKVSQNYPVVQNMQGQMVHQPISPRTLNAWVKVIEEKAFSPEIIPMFSALSEGATPQDLNTMLNTVGGHQAAMQMLKDTINEEAADWDRLHPVQAGPVAPGQMREPRGSDIAGTTSTLQEQIAWMTNNPPIPVGEIYKRWIILGLNKIVRMYSPVSILDIRQGPKEPFRDYVDRFYRTLRAEQASQDVKNWMTETLLVQNSNPDCKTILKALGPGATLEEMMTACQGVGGPGHKARVLAEAMSQIATPPTVMMQRGNFRNQRKVVKCFNCGKEGHIAKNCRAPRKRGCWKCGKEGHQMKDCTERQANFLGKIWPSSKGRPGNFPQSRLEPTAPPEESLREETITPPQRQEPPVDKEMYPWASLKSLFGNDPSSQ

SEQ ID NO: 212 - protein, 501 aa, Human immunodeficiency virus
MGARASVLSGGKLDSWEKIRLRPGGKKKYKLKHIVWASREVERLAVNPGLLETPEGCRQILGQLQPSLQTGSEELKSLYNAVAVLYCVHQRIEVKDTKEALDKIEEEQNKSKKKAQQAAAADTGNSNQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQVGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNQTAVMMQRGKFTNQRKPIKCFNCGKEGHLARNCRAPRKKGCWKCGKEGHQMKECSERQANFLGKIWPSHKGRPGNFLQSRPEPSAPPMESFRFGEETATPSQKQEQTDKELYPLASLRSLFGNDPSSQ

SEQ ID NO: 213 - protein, 504 aa, Human immunodeficiency virus
MGARASVISGGELDRWEKIRLRPGGSKKYKLKHIVWASRELERYAINPGLLETGAGCKQILEQLQPALQTGSEELKSLFNAIAVLFCVHQRIDVKDTKEALDKIEEEQNKSKKRIQQAQQAAAADTGNSSQVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKESFRDYVDRFYKTLRAEQASQEVKNWMTETLLVQNANPDCKTILKALGPAATLEEMMTACQGVGGPGHKARVLAEAMSQVTNSATIMMQKGNFRNQRKVVKCFNCGKEGHIARNCRAPRKKGCWKCGKEGHQMKDCSERQANFLGKIWPSHKGRPGNFLQSRLEPTAPPEESFRFGEEKAPPPQKQEAVDKELYPLTSLRSLFGNDPSSQ

SEQ ID NO: 214 - protein, 508 aa, Human immunodeficiency virus
MGARASVLSGGKLDKWEKIQLRPGGKKKYKLKHIVWASRELERFAVNPGLLETSGGCKQILAQLQPSLKTGSEELKSLYNTVAVLYCVHQRIEIQDTKEALDRIEEEQNKSEKKAQQAAAAAADTGNSRQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVNSATVMMQKGNFRNQRKTVKCFNCGKEGHIARNCRAPRKKGCWKCGKEGHQMKDCMERQANFLGKIWPSHKGRPGNFLQSKPEPTAPLEPTAPPEESFRFGEERTTPSQKQEPIDKGLYPLASLRSLFGNDPLSQ

SEQ ID NO: 215 - protein, 501 aa, Human immunodeficiency virus
MGARASVLSGGKLDQWEKIRLRPGGKKSYKLKHLVWASRELERFAVNPGLLETSEGCRQILGQLHPSLQTGSEELQSLYNTIAVLYCVHQRIEVKDTKEALEKIEEEQNKSKKKAQQAAADTGKNNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQGSQEVKTWMTETLLVQNANPDCKTILKALGPGATLEEMMTACQGVGGPGHKARVLAEAMSQVTNSATIMMQRGNFKNQRKIVKCFNCGREGHIARNCRAPRKRGCWKCGKEGHQMKECTERQANFLGKIWPSHKGRPGNFLQSRPEPTAPPEESFRFGEETATPPQKQEPIDKEMYPLASLRSLFGNDPSSQ

SEQ ID NO: 216 - protein, 500 aa, Human immunodeficiency virus
MGARASVLSGGELDRWEKIRLRPGGKKKYRLKHIVWASRELERFAVNPGLLETSEGCRQILEQLQPALNTGSEELRSLYNTVATLYCVHQKIEVKDTKEALDKIEEEQNKSKKKAQQAAADKGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNPTNIMMQRGNFKNQRKSVKCFNCGKEGHIARNCRAPRKKGCWKCGREGHQMKDCTERQANFLGKIWPSHKGRPGNFLQSRPEPTAPPEESFRFGEGTTIPSQKQEQIDKEMYPLTSLKSLFGNDPSSQ

SEQ ID NO: 217 - protein, 500 aa, Human immunodeficiency virus
MGARASVLSGGELDKWEKIRLRPGGKKTYKLKHIVWASRELERFAVNPGLLETSGGCRQILKQLQPSLQTGSEELKSLYNTVATLYCVHQKIEIKDTKEALDKIEEEQNKSKKREQQVAADTGNSSQVSQNYPIVQNLQGQMVHQSISPRTLNAWVKVVEEKAFSPEVIPMFSALSEGATPQDLNTMLNTVGGHQAAMQMLKETINDEAAEWDRLHPVHAGPAAPGQMREPRGSDIAGTTSTLQEQIGWMTSNPPIPVGEIYKRWIILGLNKIVRMYSPTSILDIKQGPKEPFRDYVDRFYKTLRAEQASQEVKGWMTETLLVQNANPDCKTILKALGPGATLEEMMTACQGVGGPGHKARVLAEAMSQVTNSATIMMQRGNFRNQRKTVKCFNCGKEGHIARNCRAPRKRGCWKCGKEGHQMKDCTERQANFLGKIWPSHKGRPGNFLQSRPEPTAPPEESVRFGEETTTPSQKQGTIDKDLYPLTSLRSLFGNDPSSQ

SEQ ID NO: 218 - protein, 508 aa, Human immunodeficiency virus
MGARASVLSGGELDRWEKIRLRPGGKKRYKLKHIVWASRELERFAVNPGLLETSEGCKQILRQLQPSLQTGSEELKSLYNTVATLYCVHQRIEVKDTKEALDKIEEEQNKCKKKAQQAAADTGSSSQVSQQVSQNYPIVQNLQGQMVHQAISPRTLNAWVKVVEEKAFSPEVIPMFSALSEGATPGDLNTMLNTIGGHQAAMQMLKETINEEAAEWDRLHPVHAGPVAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTTPPAIMMQRGNFRNQRKVVKCFNCGKEGHVAKNCRAPRKKGCWKCGREGHQMKDCTERQANFLGKIWPSYKGRPGNFLQNRTENRIEPTAPPEESFRFGEETATPPQKQEPIDKETYPLTSLRSLFGNDPLSQ

SEQ ID NO: 219 - protein, 501 aa, Human immunodeficiency virus
MGARASVLSGGELDRWEKIRLRPGGKKQYRLKHVVWASRELERFAINPGLLETSEGCRQILGHLQSSLQTGSEELRSLFNTVATLYCVHQKIDVRDTKEALEKVEEEQNKSKKKAQQAAADTGDSSKQVSQNYPIVQNLQGQMVHQAISPRTLNAWVKVVEEKAFSPEVIPMFTALSEGATPQDLNTMLNTVGGHQAAMQMLKETINEEAAEWDRLHPVHAGPPAPGQLREPRGSDIAGTTSTLQEQIGWMTTNPPIPVGEIYKRWIILGLNKIVRMYSPVSILDIRQGPKEPFRDYVDRFYKTLRAEQASQDVKNWMTETLLIQNANPDCRTILKALGPAPTLEEMMSACQGVGGPGHKARVLAEAMSHMTNANTIMMQRGNFRNQRKIVKCFNCGKEGHIAKNCRAPRKKGCWKCGKEGHQMKECTERQANFLGKIWPSHKGRPGNFLQSRPEPTAPPEESFRFGEETTTPSQKQEPRDRELYPLTSLKSLFGNDPSSQ

SEQ ID NO: 220 - protein, 504 aa, Human immunodeficiency virus
  variant (190)..(190): Xaa can be any naturally occurring amino acid
MGARASVLSGGELDKWEKIRLRPGGKKQYKLKHIVWASRELERFAVNPGLLETSEGCRQILGQLQPSLQTGSEELRSLYNTIAVLYCVHQKIDIKDTKEALDKIEEEQNKSKKKAQQAAADAGNSSQVSQNYPIVQNIQGQMVHQAISPRTLNAWVKVVEEKAFSPEVIPMFSALSEGATPQDLNTMLNXVGGHQAAMQMLKETINEEAAEWDRLHPVHAGPVAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTTASAAIMMQRGNFKNQRKIIKCFNCGREGHIAKNCRAPRKRGCWKCGKEGHQMKDCTERQANFLGKIWPSHKGRPGNFLQSRPEPSAPPAPPEESFRFGEETTTPCQKQEPIDKELYPLASLKSLFGNDPSSQ

SEQ ID NO: 221 - protein, 499 aa, Human immunodeficiency virus
MGARASVLSGGKLDKWEKIRLRPGGKKRYKLKHLVWASRELERFAVNPGLLETAEGCRQIIGQLQPSLQTGSEELKSLFNTVATLYCVHQGIEVKDTKEALDKIEEEQNKSKTKVQQAAAAANSSQVSQNYPIVQNLQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSNLQEQIAWMTNNPPIPVGEIYKKWIIMGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNSATIMMQKGNIRNQRKTVKCFNCGKEGHIARNCRAPRKKGCWKCGREGHQMKDCTERQANFLGKIWPSHKGRPGNFLQSRPEPTAPPEESFRFGEETTTPPQKQEPIDKELYPLASLKSLFGNDPSSQ

SEQ ID NO: 222 - protein, 500 aa, Human immunodeficiency virus
  variant (64)..(64): Xaa can be any naturally occurring amino acid
  variant (219)..(219): Xaa can be any naturally occurring amino acid
  variant (391)..(391): Xaa can be any naturally occurring amino acid
MGARASVLSGGELDKWEKIRLRPGGKKQYKLKHIVWASRELERFAVNPGLLETSGGCRQILGQXQPSLQTGSEELKSLYNTVAVLYCVHQRIDVRDTKEALEKIEEEQNKSKKKAQQAAADTGNSSQVSQNYPIVQNIQGQMVHQALSPRTLNAWVKVVEEKAFSPEVIPMFSALSEGATPQDLNTMLNTVGGHQAAMQMLKETINEEAAEWDRLHPVXAGPIAPGQIREPRGSDIAGTTSNLQEQIAWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQMTNSTNIMMQRGNIRNQKRTVXCFNCGKEGHIARNCRAPRKKGCWKCGKEGHQMKDCTERQANFLGKIWPSHKGRPGNFLQSRPEPTAPPAESFSFGEETTTPPQKQEPIDKEKYPLASLRSLFGNDPSSQ

SEQ ID NO: 223 - protein, 506 aa, Human immunodeficiency virus
MGARASILSGGELDRWEKIRLRPGGKKKYELKHIVWASRELERFAVNPGLLETADGCRQILGQLQSSLQTGSEDLKSVYNTVAVLYCVHQRIEIKDTKEALERIEEEQNKSKKRAQQAAAATGNSSQVSQNYPIVQNMQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIRQGPKEPFRDYVDRFYKTLRAEQASQEVKNWMTETLLVQNANPDCKTILKALGPAATLEEMMTACQGVGGPSHKARVLAEAMGQVTNSATIMMQRGNFRNQRRTVKCFNCGKEGHIAKNCRAPRKRGCWKCGKEGHQMKDCTERQANFLGKIWPSHKGRPGNFLQSRPEPTAPTDPTAPPEESFRFGEETTTPSQKQEQTDKELYPLASLRSLFGNDPSSQ

SEQ ID NO: 224 - protein, 503 aa, Human immunodeficiency virus
  variant (23)..(23): Xaa can be any naturally occurring amino acid
  variant (61)..(61): Xaa can be any naturally occurring amino acid
  variant (188)..(188): Xaa can be any naturally occurring amino acid
  variant (281)..(281): Xaa can be any naturally occurring amino acid
  variant (363)..(363): Xaa can be any naturally occurring amino acid
  variant (370)..(370): Xaa can be any naturally occurring amino acid
MGARASVLSGGELDKWEKIRLRXGGKKQYRLKHIVWASRELERFAVNPGLLETAAGCRQIXGQLQPSLQTGSEELKSLYNTVATLYCVHQKIQVSDTKEALDRIEEEQNKIKKKAQQEAADTGNSSQVSQNYPIVQNLQGQMVHQPMSARTLNAWVKVIEEKAFSPEVIPMFSALSEGATPQDLNTMXNTVGGHQAAMQILKETINEEAAEWDRLHPVHAGPIAPGQMREPRGSDIAGTTSNLQEQIGWMTHNPPIPVGDIYKRWIILGLNKIVRMYSPVXILDIRQGPKEPFRDYVDRFYKTLRAEQASQDVKNWMTETLLVQNANPDCKTILKALGPAATLEEMMTACQGVGGPGHKARVXAEAMSQXTNSATVMMQRGNFRNQRKTIKCFNCGKEGHIARNCRAPRKKGCWRCGKEGHQMKDCTGAQANFLGKIWPSHKGRPGNFLQNRPEPTAPPAPPEESFRFGEGTTTPSQKQEPIDKELYPLASLRSLFGNDPSSQ

SEQ ID NO: 225 - protein, 501 aa, Human immunodeficiency virus
  variant (472)..(472): Xaa can be any naturally occurring amino acid
MGARASVLSGGKLDQWEKIRLRPGGKKKYKLKHIVWASRELERFAVNPGLLETSEGCRQILGQLQPSLQTGSEELKSLYNTVAVLYCVHQRIDVKDTKEALDKIEEEQNKSKKKAQQAAADTGSSSPASQNYPIVQNLQGQMVHQAISPRTLNAWVKVIEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPISILDIRQGPKEPFRDYVDRFYKTLRAEQASQEVKNWMTETLLVQNANPDCKTILKALGPAATLEEMMTACQGVGGPSHKARILAEAMSQVTNSAANIMMQKGNFRNQRKTVKCFNCGKEGHMARNCRAPRKKGCWKCGKEGHQMKDCNERQANFLGKIWPSHKGRPGNFLQSRPEPTAPPAESFRFGEETTXPAPKQEPIDKELYPLASLKSLFGNDPSSQ

SEQ ID NO: 226 - protein, 507 aa, Human immunodeficiency virus
MGARASILSGGELDRWEKIRLRPGGKKKYRLKHIVWASRELERFAVNPGLLETSEGCKQILIQLQPSLKTGSEELKSLYNTIATLYCVHQRIDVKDTKDALDKIEEEQNKSKKKTQQAAADAGNSNTGNSSQVSQNYPIVQNVQGQMVHQAISPRTLNAWVKVIEEKAFSPEVIPMFTALSEGATPQDLNTMLNTVGGHQAAMQILKETINDEAAEWDRTHPVHAGPVAPGQMREPRGSDIAGTTSTLQEQIGWMTHNPPIPVGDIYKRWIILGLNKIVRMYSPTSILDIRQGPKEPFRDYVDRFYKTLRAEQASQDVKNWMTETLLVQNANPDCKTILKALGPGATLEEMMTACQGVGGPAHKARVLAEAMSQVTNSTSAHIMMQKGNFRNQRKNVKCFNCGKEGHIARNCRAPRRKGCWKCGKEGHQMKDCTERQANFLGKIWPSHKGRPGNFPQSRLEPTAPPEESIRFGEETTAPPQKQETTDKELYPLASLRSLFGSDPSLQ

SEQ ID NO: 227 - protein, 494 aa, Human immunodeficiency virus
MGARASVLSGEKLDKWERIRLRPGGKKQYRLKHLVWASRELERFAVNPGLLETSDGCKQILAQLQPSLPTGSEELKSLFNAIAVLYCVHRGIEVRDTKEALDKIEEEQNKSKKQAQQAAADNSQVSQNFPIVQNIQGQMVHQAISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPGATLEEMMTACQGVGGPGHKARILAEAMSQVTNSATIMMQRGNFRGQRKIVKCFNCGKEGHIAKNCKAPRRRGCWKCGKEGHQMKDCTERQANFLGKIWPSHKGRPGNFLQSRPEPSAPPEESFRFGEETTTPPQKQEPKDKEMYPLTSLRSLFGNDP

SEQ ID NO: 228 - protein, 500 aa, Human immunodeficiency virus
MGARASVLSGGKLDRWEKIRLRPGGRKKYRLKHIVWASNELERFALNPGLLETSEGCRQILGQLQPSLQTGSEEIKSLYNTVATLYCVHQNIDVKDTKEALDKIEEEQNKSKKKAQQAAAGTGNNSQVSQNYPIVQNLQGQMVHQAISPRTLNAWVKVVEEKAFSPEVIPMFTALSEGATPQDLNTMLNTVGGHQAAMQMLKETINEEAAEWDRLHPVQAGPIAPGQIREPRGSDIAGTTSNLQEQIAWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSNSIMMQRGNFRNPRKAVKCFNCGKEGHIAKNCRAPRKKGCWKCGKEGHQMKDCTERQANFLGKIWPSHKGRPGNFLQSRPEPTAPPEESFRFGEETTTPPQKQEPIDKELYPLASLKSLFGNDPSSQ

SEQ ID NO: 229 - protein, 501 aa, Human immunodeficiency virus
MGARASILSGGELDRWEKIRLRPGGKKKYRLKHIVWASRELERFAVNPGLLETADGCRQILGQLQPALQTGSEELRSLYNTVATLYCVHQRIEVKDTKEALDKIEEEQNKSKKKAQPAAAADTGNSSQVSQNYPIVQNLQGQMVHQPISPRTLNAWVKVVEEKAFSPEVIPMFTALSEGATPQDLNTMLNTVGGHQAAMQMLKETINEEAAEWDRMHPVHAGPIAPGQMREPRGSDIAGTTSTLQEQIGWMTSNPAIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNQTTIMMQRGNFRNQRKIVKCFNCGKEGHIARNCRAPRKKGCWKCGEEGHQMKDCTERQANFLGKIWPSHKGRPGNFLQSRPEPTAPPEESFRFGEETATPTQKQEPIDKEMYPLASLRSLFGNDPLSQ

SEQ ID NO: 230 - protein, 500 aa, Human immunodeficiency virus
MGARASVLSGGKLDKWERIRLRPGGKKKYKLKHLVWASRELERFAVNPGLLETAEGCRQILGQLQPSLQTGSEELKSLFNAVATLYCVHQNIEVKDTKEALDKIEEEQNKSKKKTQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNPAAVMMQRGNFKNQRKTVKCFNCGKEGHIARNCRAPRKRGCWKCGKEGHQMKDCTERQANFLGKIWPSHKGRPGNFLQSRPEPSAPPEESFRFGEEAAAPPQKQEPTDKELYPFSSLKSLFGNDPSSQ

SEQ ID NO: 231 - protein, 502 aa, Human immunodeficiency virus
  variant (372)..(372): Xaa can be any naturally occurring amino acid
MGARASVLSGGELDKWEKIYLRPGGKKKYKLKHIVWASRELERFAVNPGLLETSGGCRQILGQLQPSLQTGSEELRSLYNTVATLYCVHQKIEIRDTKEALEKIEEEQNKSKKKAQQAAAAADTGNSSQVSQNYPIVQNLQGQMVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMNQXTNSNTIMMQRGNFRNQGKNIKCFNCGKVGHIAKNCRAPRKRGCWKCGKEGHQMKDCTERQANFLGKIWPSHKGRPGNFLQSRPEPTAPPEESFRFGEGTAPPAPKQEQIDKELYPLASLKSLFGNDPSSQ

SEQ ID NO: 232 - protein, 500 aa, Human immunodeficiency virus
MGARASVLSGGKLDKWERIRLRPGGKKKYKLKHIVWASRELERFAVNPGLLETSEGCRQILGQLQPSLQTGSEELKSLFNTIATLYCVHQGIEIRDTKEALERIEEEQNKSKKKAQAAAADTESSRQVSQNYPIVQNLQGQMVHQPVSPRTLNAWVKVVEEKAFSPEVIPMFAALSEGATPQDLNTMLNTVGGHQAAMQMLKETINEEAAEWDRLHPVHAGPIAPGQMREPRGSDIAGTTSNLQEQIAWMTSNPPVPVGEIYKKWIILGLNKIVRMYSPTSILDIKQGPKEPFRDYVDRFYKTLRAEQASQEVKNWMTETLLVQNANPDCKTILKALGPAATLEEMMTACQGVGGPSHKAKVLAEAMSQVTNSTAVMMQKGNFRSQRKIVKCFNCGKEGHIAKNCRAPRRKGCWKCGKEGHQMKDCSERQANFLGKIWPSHKGRPGNFLQNRPEPTAPPEESFRFGEETTAPPQKQEPIDKELYPLASLKSLFGNDPSSQ

SEQ ID NO: 233 - protein, 501 aa, Human immunodeficiency virus
MGARASVLSGGKLDKWEKIRLRPGGKKRYKLKHIVWASRELERFAVNPGLLETAEGCRQILGQLQPSLQTGSEELKSLYNTVATLYCVHQYIEVKDTKEALDKIEEEQNKSKKRAQPAAAADTGNNSNVSQNYPIVQNSQGQMVHQAISPRTLNAWVKVIEEKAFSPEVIPMFTALSEGATPHDLNTMLNTVGGHQAAMQMLKETINDEAAEWDRLHPVHAGPIAPGQMREPRGSDIAGTTSTLQEQIAWTTNNPPIPVGEIYKRWIILGLNKIVRMYSPTSILDIKQGPKEPFRDYVDRFYKTLRAEQATQEVKNWMTETLLVQNANPDCKTILRALGPAATLEEMMTACQGVGGPGHKARVLAEAMSQVTNANAIMIQRGNFKGQRKTVKCFNCGKEGHIARNCRAPRKKGCWKCGQEGHQMKDCNERQANFLGKIWPSHKGRPGNFLQSRPEPTAPPEKSLRFGEGTTPPSQKQEPIDKEMYPLASLRSLFGNDPSSQ

SEQ ID NO: 234 - protein, 512 aa, Human immunodeficiency virus
MGARASVLSGGKLDKWEKIRLRPGGKKKYRLKHLVWASRELERFAVNPGLLETAEGCRQILGQLQPALQTGSEELKSLFNAIAVLYCVHQNIEIKDTKEALDKIEEEQNKCKKKTQQAAADTGNSGNTGNSSHVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPTSILDIKQGPKESFRDYVDRFYKTLRAEQATQEVKNWMTETLLVQNANPDCKTILKALGPAATLEEMMTACQGVGGPGHKARVLAEAMSQVTNSTAIMMQKGNFKNQRKTIKCFNCGKEGHLARNCRAPRKKGCWKCGKEGHQMKDCTERQANFLGKIWPSHKGRPGNFLQSRPEPTAPPEPTAPPEESFRFGEETATPPQGQRQTDKDLYPLTSLRSLFGNDPSSQ

SEQ ID NO: 235 - protein, 499 aa, Human immunodeficiency virus
MGARASVLSGGELDRWEKIRLRPGGKKKYRLKHIVWASRELERFAVNPGLLETSEGCRQILGQLQPALQTGSEELKSLFNTIAVLYCVHQRVEVKDTKEALDKIEEEQNKVKKKTQQAAADTESKSPVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPTSILDIKQGPKEPFRDYVDRFYRTLRAEQASQEVKNWMTETLLVQNSNPDCKTILKALGPAATLEEMMTACQGVGGPSHKARVLAEAMGQVTNSATIMMQRGNFRNKKIVKCFNCGREGHIARNCKAPRKRGCWKCGKEGHQMKDCTERQANFLGKIWPSHKGRPGNFLQSRPEPTAPPEESFRFGEETTTPSQKQETVDKEHYPLTSLRSLFGNDPSSQ

SEQ ID NO: 236 - protein, 502 aa, Human immunodeficiency virus
MGAGASILSGGELDRWERIRLRPGGKKKYRLKHVVWASRELERFAVNPGLLETSEGCRQILGQLQPALQTGSEELKSLYNTVATLYCVHQRIDVKDTKEALEKIEEEQNKFKKKAQQAAAGAGTGTSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSHVTNANTIMMQRGNFKNQKKVVKCFNCGKEGHIAKNCRAPRKRGCWKCGREGHQMKDCTERQANFLGKIWPSHKGRPGNFLQSRPEPTAPPAESFGFGEETTTPSQKQEPIDKELYPLTSLRSLFGSDPSSQ

SEQ ID NO: 237 - protein, 501 aa, Human immunodeficiency virus
MGARASVLSGGKLDQWEKIRLRPGGKKKYRLKHLVWASRELERYALNPGLLETSDGCKQIIAQLQPSIPTGSEELKSLYNAVAVLYCVHQRIDVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINDEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQMTGSATVMMQKGNFRNQRKIVKCFNCGKEGHIARNCRAPRKKGCWKCGREGHQMKDCNNERQANFLGKIWPSSKGRPGNFLQSRPEPTAPPEESFRFGEETATPPQKQEPRDKDLYPLASLKSLFGNDPSSQ

SEQ ID NO: 238 - protein, 500 aa, Human immunodeficiency virus
MGARASVLSGGELDKWEKIRLRPGGKKQYKLKHIVWASRELERFALNPGLLETSEGCRQILGQLQPALGTGTEELKSLFNTVAVLYCVHQKIAIKDTKEALDKIEEEQNKSKKKTQQAEADTGNRSQVSQNYPIVQNLQGQMVHQPIAPRTLNAWVKVVEEKAFSPEVIPMFSALSEGATPQDLNTMLNTVGGHQAAMQMLKETINEEAADWDRLHPVQAGPVAPGQMREPRGSDIAGTTSTLQEQIGWMTSNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQVTNSTTVMVQRGNFRNQRKTVKCFNCGKEGHIAKNCRAPRKKGCWKCGREGHQMKDCTERQANFLGKIWPSHKGRPGNFLQSRPEPTAPPAESFRFGEETTTPSQKQEPIDKELYPLASLRSLFGNDPSSQ

SEQ ID NO: 239 - protein, 502 aa, Human immunodeficiency virus
MGARASVLSGGELDRWEKIRLRPGGKKRYRLKHLVWASRELERFAVNPGLLETSGGCRQILEQLQPSLQTGSEELKSLYNTIAVLYCVHQKIEVKDTKEALDKIEEEQNKSKKKAQQAAADTGSNSKVSQNYPIVQNLQGQMVHQPMSPRTLNAWVKVIEEKAFSPEVIPMFSALSEGATPQDLNTMLNTVGGHQAAMQMLKETINEEAAEWDRMHPVHAGPVAPGQMREPRGSDIAGTTSTLQEQIAWMTSNPSIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNTNIMMQRGNFRNQRQTVKCFNCGKEGHIAKNCRAPRKRGCWKCGKEGHQMKDCTERQANFLGKIWPSNKGRPGNFLQNRPEPTAPPAPPEESFRFRGETTTPPQRQEPTDKELYPLASLKSLFGNDPSSQ

SEQ ID NO: 240 - protein, 497 aa, Human immunodeficiency virus
  variant (193)..(193): Xaa can be any naturally occurring amino acid
MGARASVLSGGELDKWEKIRLRPGGKKQYKLKHIVWASRELERFAVNPGLLETSEGCRQILGQLHPSLQTGSEELKSLYNTVAVLYCVHQRIEVKDTKEALEKIEEEQNKAKKKAQQAAADTGNSQVSQNYPIVQNIQGQMVHQPISPRTLNAWVKVIEEKAFSPEVIPMFSALSEGATPQDLNTMLNTVGGXQAAMQMLKETINEEAADWDRLHPVQAGPVAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLVQNANPDCKTILKALGPGATLEEMMTACQGVGGPGHKARVLAEAMSQATGPAAIMMQRGNFRGQRKIVKCFNCGKEGHIAKNCRAPRKRGCWKCGKEGHQMKDCTERQANFLGKIWPSHKGRPGNFPQNRLEPTAPPAESFREETTTPPQKQEPIDKELYPIPSLRSLFGNDPSSQ

SEQ ID NO: 241 - protein, 502 aa, Human immunodeficiency virus
MGARASVLSGGELDRWEKIRLRPGGKKKYRLKHIVWASRELERFAVNPSLLETSEGCRQILGQLQPSLQTGSEELRSLYNTVATLYCVHQKIDVKDTKEALDKIEEEQNKCKKKAQQAAAAADTGNNSQISQNYPIVQNVQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPVSILDIKQGPKEPFRDYVDRFYKTLRAEQATQEVKNWMTETLLVQNANPDCKTILKALGPAATLEEMMTACQGVGGPGHKARVLAEAMSQVTNSTATAMMQRGNFRNQKIVKCFNCGKAGHIAKNCRAPRKKGCWKCGKEGHQMKDCTERQANFLGKIWPSHKGRPGNFLQNRPEPSAPPEESFRFGEETTTPSQKQEPKDKDLYPLASLRSLFGNDPSSQ

SEQ ID NO: 242 - protein, 500 aa, Human immunodeficiency virus
MGARASVLSGGELDRWEKIRLRPGGKKKYKLKHIVWASRELERFAVNPGLLETSEGCRQIIGQLQPSLQTGSEELKSLFNTVAVLYCVHQKIDIKDTKEALEKIEEEQNKSKKKAQQAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQATNTVAIMMQRGNFKNQRKTIKCFNCGREGHIAKNCRAPRKKGCWKCGKEGHQMKDCTERQANFLGKIWPSHKGRPGNFLQNRPEPSAPPAESFRFGEETTTPSQKQEPIDKDLYPLASLRSLFGNDPSSQ

SEQ ID NO: 243 - protein, 497 aa, Human immunodeficiency virus
MGARASVLSGGELDKWEKIRLRPGGRKQYKLKHIVWASRELERFALNPGLLETSEGCRQILGQLQASLQTGSEELKSLYNTVAVLYCVHQRIDVKDTKEALEKIEEEQNKSKKKAQQAAADTGSSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQIREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMCQVTNPATVMMQRGNLKNQRKTVKCFNCGKEGHIARNCRAPRKKGCWKCGKEGHQMKDCTERQANFLGKIWPSHKGRPGNFLQSRPEPTAPPEESFKFGEETTTPPQKQGTIDKELYPLASLKSLFGNDQ

SEQ ID NO: 244 - protein, 502 aa, Human immunodeficiency virus
MGARASVLSGGELDKWEKIRLRPGGKKSYQLKHIVWASRELERFAVNPGLLETSEGCRQILGQLHPSLQTGSEELKSLYNTVAVLYCVHQRIEIKDTKEALDKIEEEQKQSKKKAQQAQAAAGTGSSSQVSQNYPIVQNLQGQMVHQAISPRTLNAWVKVVEEKAFSPEVIPMFSALSEGATPQDLNTMLNTVGGHQAAMQMLKETINEEAAEWDRLHPAHAGPIAPGQMREPRGSDIAGTTSTLQEQIGWMTHNPPIPVGEIYKKWIIMGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQATNSAAIMMQRGNYKNQRKTVKCFNCGKEGHIARNCRAPRKKGCWKCGKEGHQMKDCTERQANFLGKIWPSHKGRPGNFLQSRPEPSAPPEESFRFGEETTAPSQKQEPTDKEMYPLASLKSLFGNDPSSQ

SEQ ID NO: 245 - protein, 508 aa, Human immunodeficiency virus
  variant (283)..(283): Xaa can be any naturally occurring amino acid
MGARASVLSGGQLDKWEKIRLRPGGKKRYKLKHIVWASRELERFAVNPGLLETSGGCRQILELLQPSLQTGSEELRSVYNTVATLYCVHQQIEVKDTKEALDKVEEEQNKSKKKAQQAAAAADTGNSSQVSQNYPIVQNMQGQMVHQAISPRTLNAWVKVVEEKAFSPEVIPMFSALSDGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTXILDIRQGPKESFRDYVDRFYKTLRAEQASQEVKNWMTETLLVQNANPDCRTILKALGPAATLEEMMTACQGVGGPGHKARVLAEAMSQVTNSATIMMQRGNFKNQKKTVKCFNCGKEGHIARNCRAPRKKGCWKCGKEGHQMKDCTERQANFLGKIWPSYKGRPGNFLQSRPEPTAPPEESFRFGEGTTTPTQKTTPSQEQEPIDKDLYPLASLKSLFGSDPSSQ

SEQ ID NO: 246 - protein, 500 aa, Human immunodeficiency virus
  variant (108)..(108): Xaa can be any naturally occurring amino acid
MGARASVLSGGELDRWEKIRLRPGGKKKYKLKHIVWASRELERFAVNPGLLETSEGCRQILGQLQPALQTGSEELKSLYNTVATLYCVHQKIEIADTKEALEKIEEEXNKSKKKAQQAAAGPGSSSQVSQNYPIVQNIQGQMVHQALSPRTLNAWVKVVEEKAFSPEVIPMFSALSEGATPQDLNTMLNTVGGHQAAMQMLKETINEEAAEWDRLHPVQAGPVAPGQMREPRGSDIAGTTSNLQEQIAWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMVQGGNFKSQRKIVKCFNCGKEGHIAKNCRAPRKRGCWKCGKEGHQMKDCTERQANFLGKIWPSHKGRPGNFLQSRPEPTAPPEESFRFGEETTTPSQKQETIDKEGYPLTSLRSLFGNDPSSQ

SEQ ID NO: 247 - protein, 501 aa, Human immunodeficiency virus
  variant (170)..(170): Xaa can be any naturally occurring amino acid
  variant (192)..(192): Xaa can be any naturally occurring amino acid
  variant (246)..(246): Xaa can be any naturally occurring amino acid
  variant (249)..(249): Xaa can be any naturally occurring amino acid
  variant (252)..(252): Xaa can be any naturally occurring amino acid
  variant (277)..(277): Xaa can be any naturally occurring amino acid
  variant (286)..(286): Xaa can be any naturally occurring amino acid
  variant (300)..(300): Xaa can be any naturally occurring amino acid
  variant (401)..(401): Xaa can be any naturally occurring amino acid
MGARASVLSGGELDRWEKIRLRPGGRKRYKLKHIIWASRELERFAVNPGLLETSEGCRQILGQLQPSLQTGSEELKSLYNTVAVLYCVHQKIDVKDTKEALDKIEEEQNKSKKKAQQAAAAADTGNSNQASQNYPIVQNLQGQMVHQALSPRTLNAWVKVIEEKAFSPEXIPMFSALSEGATPQDLNTMLNXVGGHQAAMQMLKETINEEAAEWDRLHPVHAGPIAPGQMREPRGSDIAGTTSTLXEQXAWXTNNPPIPVGEIYKRWIILGLNKIVXMYSPVSILXIRQGPKEPFRDYVXRFYKTLRAEQASQDVKNWMTETLLVQNANPDCKTILKALGPAATLEEMMTACQGVGGPGHKARVLAEAMSQVNSTTIMMQKGKFRNQRKTVKCFNCGKEGXIARNCRAPRKKGCWKCGREGHQMKDCTERQANFLGKIWPSSKGRPGNFLQSRPEPTAPPAESFGFGEETTTPSQKQDQKEKELYPLASLRSLFGNDPLSQ

SEQ ID NO: 248 - protein, 501 aa, Human immunodeficiency virus
  variant (81)..(81): Xaa can be any naturally occurring amino acid
  variant (118)..(118): Xaa can be any naturally occurring amino acid
  variant (353)..(353): Xaa can be any naturally occurring amino acid
  variant (484)..(484): Xaa can be any naturally occurring amino acid
MGARASILSGGELDRWEKIRLRPGGKKKYRLKHLVWASRELERFAVNPGLLETSEGCRQLLGQLQPSLQTGSEELKSLYNXIAVLYCVHQRIDVKDTKDALDKIEEEQNKSRKKAQQXAADTGNNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMRDPRGSDIAGTTSTLQEQIGWMTSNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGXGGPGHKARVLAEAMSQATNSNTIMMMQRGNFRNQRKTIKCFNCGKEGHLARNCRAPRKKGCWKCGKEGHQMKDCTERQANFLGKIWPSYKGRPGNFLQSRPEPTAPPEESFRFGKETTTPPQKQEPIDKDXYPLASLRSLFGNDPSSQ

SEQ ID NO: 249 - protein, 500 aa, Human immunodeficiency virus
  variant (462)..(462): Xaa can be any naturally occurring amino acid
  variant (469)..(469): Xaa can be any naturally occurring amino acid
MGARASVLSGGELDKWEKIRLRPGGKKKYKLKHIVWASRELERFAVNPGLLETSEGCRQILGQLQPALQTGSEELRSLYNTVATLYCVHQKIEVKDTKEALEKIEEEQNKSKKKVQQAAADTGNSSQVSQNYPIVQNMQGQMVHQPLSPRTLNAWVKVVEEKAFSPEVIPMFTALSEGATPQDLNTMLNTVGGHQAAMQMLKETINEEAAEWDRLHPVHAGPVAPGQMREPRGSDIAGTTSNLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATAMVQRSNFRNQRKIVKCFNCGKEGHIARNCRAPRKKGCWKCGKEGHQMKDCTERQANFLGKIWPSHKGRPGNFLQNRPEPTAPPEEXFRFGEEXTTPSQKQEPIDKELHPLASLRSLFGNDPSSQ

SEQ ID NO: 250 - protein, 504 aa, Human immunodeficiency virus
  variant (72)..(72): Xaa can be any naturally occurring amino acid
  variant (79)..(79): Xaa can be any naturally occurring amino acid
  variant (135)..(135): Xaa can be any naturally occurring amino acid
  variant (186)..(186): Xaa can be any naturally occurring amino acid
  variant (259)..(259): Xaa can be any naturally occurring amino acid
  variant (295)..(295): Xaa can be any naturally occurring amino acid
  variant (357)..(357): Xaa can be any naturally occurring amino acid
  variant (383)..(383): Xaa can be any naturally occurring amino acid
MGARASVLSGGELDRWEKIRLRPAGKKKYRLKHIVWASRELERFAVNPGLLETSEGCKQIMGQLHPSLQTGXEELKSLXNAIAVLYCVHQKIEVKDTKEALEKIEEEQNKYKKKAQQAAADTGNSSQVSQNFPIXQNIQGQMVHQAISPRTLNAWVKVVEEKAFSPEVIPMFSALSEGATPQDLNXMLNTVGGHQAAMQMLKETINEEAAEWDRLHPVQAGPVAPGQMREPRGSDIAGTTSNLQEQIAWMTHNPPVPVXEIYKRWIILGLNKIVRMYSPTSILDIRQGPKEPFRXYVDRFYKTLRAEQASQEVKNWMTETLLVQNANPDCKTILKALGPAATLEEMMTACQGVGGPXHKARILAEAMSQATNSVAMTMMQRGXFRNQRKIVKCFNCGKEGHIAKNCRAPRKKGCWKCGKEGHQMKDCTERQANFLGKIWPSHSGRPGNFLQSRPEPTVPTAPPAESFRFGEETTTPSQKQEPIDKELYPLASLKSLFGNDPSSQ

SEQ ID NO: 251 - protein, 500 aa, Human immunodeficiency virus
  variant (86)..(86): Xaa can be any naturally occurring amino acid
MGARASILSGGELDRWEKIRLRPGGKKKYKLKHLVWASRELERFAVNPGLLETSEGCRQLLGQLQPALQTGSEELKSVYNTIATLXCVHQRIEVKDTKEALDKIEEEQNKSKKRVQQAAAATGISGQVSQNYPIVQNIQGQMVHQPISPRTLNAWVKVVEEKAFSPEVIPMFSALAEGATPQDLNTMLNTVGGHQAAMQMLKETINEEAAEWDRLHPVQAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVTNPATIMMQRGNFKNQRKIVKCFNCGREGHIAKNCRAPRKKGCWKCGKEGHQMKDCTERQANFLGKIWPSYKGRPGNFPQSRLEPTAPPEESLRFGEETATPHQKQEPIDKELYPLASLRSLFGNDPSSQ

SEQ ID NO: 252 - protein, 497 aa, Human immunodeficiency virus
MGARASVLSAGELDNWEKIRLRPGGKKKYRLKHIVWASRELERFAVNPGLLETSEGCRQILGQLQPSLQTGSEELRSLYNTVATLYCVHQKIKVKDTKEALEKIEEEQNKSKKKAQQAAADSNQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKESFRDYVDRFYKTLRAEQASQEVKNWMTETLLVQNANPDCKTILKALGPAATLEEMMTACQGVGGPSHKARVLAEAMSQVTNPATIMMQRGNFRNQRKTVKCFNCGREGHIAKNCRAPRKKGCWKCGKEGHQMKDCTERQANFLGKIWPSHKGRPGNFLQSRPEPTAPPEESFRFGEEATTPSQKQEPIDKELYPLASLRSLFGNDPSSQ

SEQ ID NO: 253 - protein, 499 aa, Human immunodeficiency virus
MGARASVLSGGELDRWEKIRLRPGGKKKYKLKHIVWASRELERFAVNPGLLETSEGCKQILEQLQPALQTGSEELRSLYNTVATLYCVHQKVEVKDTKEALEKIEEEQNKSKKRAQQTADTGKSSQVSQNYPIVQNLQGQMVHQALSPRTLNAWVKVVEEKAFSPEVIPMFTALSEGATPQDLNTMLNTVGGHQAAMQMLKETINEEAADWDRLHPVHAGPIAPGQMREPRGSDIAGTTSTLQEQIGWMTNNPPIPVGEIYKRWIIMGLNKIVRMYSPTSILDIRQGPKESFRDYVDRFYKTLRAEQCSQDVKNWMTETLLVQNANPDCKTILKALGPAATLEEMMTACQGVGGPGHKARVLAEAMSQVTNSTTIMMQRGNFRSQRKIVKCFNCGKEGHIAKNCRAPRKKGCWKCGKEGHQMKDCTERQANFLGKIWPSYKGRPGNFLQSRPEPTAPPAESFRFGEETTTPSQKQEPIDRELYPLASLKSLFGNDPSSQ

SEQ ID NO: 254 - protein, 500 aa, Human immunodeficiency virus
  variant (54)..(54): Xaa can be any naturally occurring amino acid
  variant (69)..(69): Xaa can be any naturally occurring amino acid
  variant (118)..(118): Xaa can be any naturally occurring amino acid
  variant (148)..(148): Xaa can be any naturally occurring amino acid
  variant (214)..(214): Xaa can be any naturally occurring amino acid
  variant (252)..(252): Xaa can be any naturally occurring amino acid
  variant (268)..(268): Xaa can be any naturally occurring amino acid
  variant (300)..(300): Xaa can be any naturally occurring amino acid
  variant (478)..(478): Xaa can be any naturally occurring amino acid
MGARASVLSGGELDKWEKIRLRPGGKKRYKLKHIVWASRELERFAVNPGLLETXEGCRQILGQLQPALXTGSEELRSLFNTVATLYCVHQKIEVKDTKEALEKIEEEQNKSKKKAQQXAAGTGNSSQVSQNYPIVQNLQGQMVHQPLXPRTLNAWVKVVEEKAFSPEVIPMFSALSEGATPQDLNTMLNTVGGHQAAMQMLKETINEEAAEWDXLHPVHAGPIAPGQMREPRGSDIAGTTSNLQEQIGWMTXNPPIPVGEIYKRWIIXGLNKIVRMYSPTSILDIRQGPKEPFRDYVDRXYKTLRAEQASQEVKNWMTETLLVQNANPDCKTILKALGPAATLEEMMTACQGVGGPGHKARVLAEAMSQVTSSATIMMQRGNFRNQRKTVKCFNCGREGHIAKNCRAPRKKGCWKCGKEGHQMKDCTERQANFLGKIWPSYKGRPGNFLQSRPEPTAPPEESFRFGEETTTPSQKQEXIDKDLYPLTSLRSLFGNDPSSQ

SEQ ID NO: 255 - protein, 500 aa, Human immunodeficiency virus
  variant (335)..(335): Xaa can be any naturally occurring amino acid
MGARASVLSGGKLDRWEKIRLRPGGKKKYKLKHIVWASRELERFAVNPGLLETAEGCRQILGQLQPSLQTGSEELKSLFNTVVTLYCVHQRIDVKDTKEALEKIEEEQNKCKKKAQQAAADTGNTGNSSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYRTLRAEQASQEVKNWMTETLLVQNANPDCKXILKALGQGATLEEMMTACQGVGGPSHKARVLAEAMSQATSVNIMMQKGNFRGQRKTVKCFNCGREGHIAKNCRAPRKKGCWKCGKEGHQMKDCSERQANFLGRIWSSHKGRPGNFLQNRTEPTAPPEEIVRFGEETTTPSQKQESGELYPLTSLKSLFGNDPSSL

SEQ ID NO: 256 - protein, 500 aa, Human immunodeficiency virus
  variant (91)..(91): Xaa can be any naturally occurring amino acid
  variant (140)..(140): Xaa can be any naturally occurring amino acid
  variant (186)..(186): Xaa can be any naturally occurring amino acid
  variant (191)..(191): Xaa can be any naturally occurring amino acid
  variant (219)..(219): Xaa can be any naturally occurring amino acid
  variant (404)..(404): Xaa can be any naturally occurring amino acid
MGARASILSGGELDRWERIRLRPGGKKKYKLKHLVWASRELERFAVNPGLLETSEGCRQILGQLQPFLQTGSEELKSLYNAVATLYCVHQXIEVKDTKEALEKIEEEQNKSKQKAKQAAAGPGNSSQVSQNYPIVQNLQXQMVHQALSPRTLNAWVKVVEEKAFSPEVIPMFSALSEGATPQDLNXMLNTXGGHQAAMQMLKETINEEAAEWDRLHPVXAGPIAPGQLREPRGSDIAGTTSNLQEQIGWMTHNPPIPVGEIYKRWIIMGLNKIVRMYSPTSILDIKQGPKESFRDYVDRFYKTLRAEQASQEVKNWMTETLLVQNANPDCKTILKALGPAATLEEMMTACQGVGGPSHKARVLAEAMSQVTSSATVMMQKGNFKSQKRNIKCFNCGREGHLARXCRAPRKKGCWKCGKEGHQMKDCTERQANFLGKIWPSSRGRPGNFLQSRPEPTAPPEESFRFGEETTTPPQKQETKDKELYPLASLRSLFGNDPSSQ

SEQ ID NO: 257 - protein, 502 aa, Human immunodeficiency virus
  variant (12)..(12): Xaa can be any naturally occurring amino acid
  variant (136)..(136): Xaa can be any naturally occurring amino acid
  variant (225)..(225): Xaa can be any naturally occurring amino acid
  variant (270)..(270): Xaa can be any naturally occurring amino acid
  variant (286)..(286): Xaa can be any naturally occurring amino acid
  variant (333)..(333): Xaa can be any naturally occurring amino acid
  variant (392)..(392): Xaa can be any naturally occurring amino acid
  variant (407)..(407): Xaa can be any naturally occurring amino acid
  variant (454)..(454): Xaa can be any naturally occurring amino acid
MGARASVLSGGXLDRWEKIRLRPGGKKKYKLKHIVWASRELERFAVNPGLLETSAGCRQILGQLQPSLQTGSEELKSLYNTVATLYCVHQKIEVKDTKEALERIEEEQNKSKKKVQQATADTGNSNSSQVSQNYPXVQNLQGQMVHQALSPRTLNAWVKVVEEKAFSPEVIPMFSALSEGATPQDLNTMLNTVGGHQAAMQMLKETINEEAAEWDRLHPVHAGPXAPGQMREPRGSDIAGTTSTLQEQIAWMTNNPPIPVGEIYKRWIIXGLNKIVRMYSPVNILXIRQGPKEPFRDYVDRFYKTLRAEQASQDVKNWMTETLLVQNANPDCXTILKALGPAATLEEMMTACQGVGGPGHKARVLAEAMSQVTSSATIMMQKGNFKNQRKAXKCFNCGKEGHIARNXRAPRKKGCWKCGKEGHQMKDCTERQANFLGKIWPSHKGRPGNFLQSXPEPTAPPEESFRFGEETTTPSQKQEPIDKDLYPLASLRSLFGNDPSSQ

SEQ ID NO: 258 - protein, 500 aa, Human immunodeficiency virus
MGARASVLSGGELDRWEKIRLRPGGKKKYRLKHIVWASRELERFAINPGLLETSGGCKQILEQLQSALQTGSEELRSLYNTVATLYCVHQKIDVKDTKEALDKIEEEQNKSKKKAQQAAADTGKSSLVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMIQKGNFRNQRKTVKCFNCGKEGHKARNCRAPRKKGCWKCGKEGHQMKDCTERQANFLGKIWPSHKGRPGNFLQNRPEPTAPPEESFRFGEETATPSQKQGTIDKELPPLTSLRSLFGNDPLSQ

SEQ ID NO: 259 - protein, 502 aa, Human immunodeficiency virus
  variant (324)..(324): Xaa can be any naturally occurring amino acid
MGARASVLSGGQLDRWEKIRLRPGGKKQYRLKHLVWASRELERFSINPNLLETAEGCRQILGQLQPALQTGSEELKSLFNTVAVLYCVQQRIDVKDTKEALDKIEEEQNKSKAKTQQAAAGTGNSSQVSQNYPIVQNLQGQMVHQPISPRTLNAWVKVIEEKAFSPEVIPMFTALSEGATPQDLNTMLNTVGGHQAAMQMLKETINEEAAEWDRLHPVHAGPVAPGQMREPRGSDIAGTTSTLQEQIGWMTSNPAIPVGEIYKRWIILGLNKIVRMYSPVSILDIRQGPKEPFRDYVDRFYKTLRAEQASQDVKNWMTETLLVXNANPDCRTILKALGPAATLEEMMTACQGVGGPGHKARVLAEAMSQAQNSNIVMMQKGNFRNQRKTVKCFNCGKEGHIARNCRAPRKRGCWRCGKEGHQMKDCTERQANFLGKIWPSHKGRPGNFLQSRPEPTAPPEESFRFGEETTAPSQKKEQGDKDKDLYPLNSLRSLFGNDPLSQ

SEQ ID NO: 260 - protein, 501 aa, Human immunodeficiency virus
  variant (195)..(195): Xaa can be any naturally occurring amino acid
MGARASILSGGELDRLEKIRLRPGGKKKYRLKHLVWASRELERFAVNPGLLETSDGCKQILIQLQPSLQTGSEELKSLFNTVAVLYCVHQKIEIKDTKEALDKIEEEQNKSKKKVQQAAAAADTGNNSQVSQNYPIVQNLQGQMVHQSLSPRTLNAWVKVVEEKAFSPEVIPMFSALSEGATPQDLNTMLNTVGXHQAAMQMLKETINEEAAEWDRMHPVHAGPIAPGQMREPRGSDIAGTTSTLQEQVAWMTSNPPVPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNPANIMMQRGNFKNQRRIVKCFNCGKEGHVAKHCRAPRKKGCWKCGKEGHQMKDCVERQANFLGKIWPSHKGRPGNFLQSRPEPTAPPEEIFRFGEEPTAPPQKQEARDEKYPLTALRSLFGNDPSSQ

SEQ ID NO: 261 - protein, 509 aa, Human immunodeficiency virus
MGARASVLSGGELDRWEKIRLRPGGKKKYRLKHIVWASRELERFAVNPGLLETSEGCRQILGQLQPSLQTGSEELRSLYNTIAVLYCVHQRIDVKDTKEALEKIEEEQNKSKKKAQQAQQAAAAAADTGNSKQVSQNYPIVQNMQGQMVHQAISPRTLNAWVKVIEEKAFSPEVIPMFTALSEGATPQDLNTMLNTVGGHQAAMQMLKETINEEAAEWDRVHPVHAGPVAPGQMREPRGSDIAGTTSTLQEQVGWMTSNPPIPVGEIYKRWIILGLNKIVRMYSPVSILDIRQGPKEPFRDYVDRFYKTLRAEQASQEVKNWMTETLLVQNSNPDCKTILKALGPGATLEEMMTACQGVGGPSHKARVLAEAMSQATNAATIMMQKGNFRNQRKPVKCFNCGKEGHIARNCRAPRKRGCWKCGKEGHQMKDCTERQVNFLGKIWPSHKGRPGNFLQNRLEPTAPSAPPAESFGFGEETATPPQKQEQIDKELYPLTSLKSLFGNDLLSQ

SEQ ID NO: 262 - protein, 499 aa, Human immunodeficiency virus
MGARASVLSGGKLDQWEKIRLRPGGKKKYKLKHIVWASRELERFAVNPGLLETSEGCKQILGQLQPSLQTGSEELKSLYNTVAVLYCVHQRIEVRDTKEALDRIEEEQNKSKKKAQQAAADTGNSNQVSQNYPIVQNLQGQMVHQAISPRTLNAWVKVIEEKAFSPEVIPMFSALSEGATPGDLNTMLNTVGGHQAAMQMLKETINEEAAEWDRLHPVQAGPIAPGQIREPRGSDIAGTTSTLQEQITWMTSNPPIPVGDIYKRWIILGLNKIVRMYSPTSILDIRQGPKEPFRDYVDRFYKTLRAEQCTQEVKNWMTETLLVQNANPDCRTILKALGPAATLEEMMTACQGVGGPGHKARVLAEAMSQVTNSATIMMQRGNFKNQRKNVKCFNCGKEGHIAKNCRAPRRKGCWKCGKEGHQMKDCSERQANFLGKIWPSYKGRPGNFLQSRPEPTAPPEESFRLGEETTPPQRRESIDKEKYPLTSLRSLFGNDPLSQ

SEQ ID NO: 263 - protein, 503 aa, Human immunodeficiency virus
MGARASVLSGGELDRWEKIRLRPGGKKKYKLKHIVWASRELERFAVNPGLLETSEGCRQILGQLQPSLQTGSEEFRSLYNAIAVLYCVHQRIDVKDTKEALEKIEEEQTKSKKKAQQAAAAAAATGNSSQVSQNYPIVQNMQGQMVHQAISPRTLNAWVKVVEEKAFSPEVIPMFAALSEGATPQDLNLMLNTVGGHQAAMQMLKETINEEAAEWDRLHPVHAGPVAPGQMREPRGSDIAGTTSTLQEQIAWMTSNPPIQVGEIYKRWIILGLNKIVRMYSPTSILDIKQGPKEPFRDYVDRFYRTLRAEQASQEVKNWMTETLLVQNSNPDCKTILKALGPAATLEEMMTACQGVGGPSHKARVLAEAMSQVTNPTTIMMQKGNFRNQRRSIKCFNCGKEGHTAKNCRAPRKKGCWKCGKEGHQMKDCTERQANFLGKIWPSHKGRPGNFLQSRPEPSAPPAESFGFGEETTTPSQKQETVDKELYPLASLKSLFGNDPSSQ

SEQ ID NO: 264 - protein, 507 aa, Human immunodeficiency virus
MGARASVLSGGQLDKWEKIRLRPGGKKKYKLKHIVWASRELERYALNPGLLETAEGCRQILGQLQPSLPTGSEELKSLFNTVATLYCVHQRIEVKDTKEALDKIEEEQNKSKKKVQQEAAAADTGNNNQVSQNYPIVQNLQGQHVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPTSILDIRQGPKEPFRDYVDRFYKTLRAEQASQEVKNWMTETLLVQNANPDCRNILKALGPAATLEEMMTACQGVGGPGHKARVLAEAMSQVTNSATIMMQKGNFRDKRKTVKCFNCGREGHIARNCRAPRKRGCWKCGKEGHQMKDCTERQANFLGKIWPSSKGRPGNFLQSRPEPSAPPEPSAPPEESFRFGEETTPAQKQERTDRELYPLASLRSLFGNDPLSQ

SEQ ID NO: 265 - protein, 503 aa, Human immunodeficiency virus
MGARASVLSGGELDRWEKIRLRPGGKKKYKLKHIVWASRELERFAVNPGLLETSGGCRQILEQLQPSLQTGSEELKSLYNTVATLYCVHQRMEIKDTKEALDKIEEERTKSKKKAQAQQAAAADTGNSSQVSQNYPIVQNAQGQMVHQAISPRTLNAWVKVVEEKAFNPEVIPMFAALSEGATPQDLNTMLNTVGGHQAAMQILKETINEEAAEWDRLHPVHAGPIAPGQMREPRGSDIAGTTSTLQEQIGWMTHNPPIPVGEIYKKWIIMGLNKIVKMYSPISILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKTVKCFNCGKEGHIARNCRAPRKRGCWKCGKEGHQMKDCTERQANFLGKIWPSHKGRPGNFLQSRPEPSAPPEESFRFGEETATPPQKQEQTDKELYPLASLRSLFGNDPSSQ

SEQ ID NO: 266 - protein, 497 aa, Human immunodeficiency virus
MGARASVLSGGKLDQWERIRLRPGGNKRYKLKHIVWASRELERFAVNPGLLETSEGCRQILKQLHPSLQTGSEELKSLYNTVATLYCVHQRIDIKDTKEALDKIEEEQNQCKKKAQQAAAGTGSSSQASQNYPIVQNMQGQMVHQAISPRTLNAWVKVIEEKAFSPEVIPMFSALSEGATPADLNTMLNTVGGHQAAMQMLKETINEEAAEWDRMHPVHAGPVAPGQMREPRGSDIAGTTSTLQEQIAWMTSNPPIPVGDIYKRWIILGLNKIVRMYSPVSILDIKQGPKEPFRDYVDRFYKTLRAEQATQEVKNWMTETLLVQNANPDCKTILKALGPAATLEEMMTACQGVGGPGHKARVLAEAMSQVTSSAAIMMQRGNFGDQRKTVKCFNCGREGHVAKNCRAPRKKGCWKCGKEGHQMKDCTGRQANFLGKIWPAHRDRPGNFLQNRPEPTAPPEESFRFGEETTTPPQKQGKEDKELYPSTSLKSLFGNDP

SEQ ID NO: 267 - protein, 502 aa, Human immunodeficiency virus
MGARASILSGGELDKLEKIRLRPGGKKKYRLKHIVWASRELERFAVNPGLLETSEGCRQILGQLQPALQTGSEELRSLYNTVAVLYCVHQRIEIKDTKEALDKIEEEQTKSKKKTQQAAADTGNNSQVKVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMSQATNSNTIMMQRGNFRNQRKTIKCFNCGKEGHLARNCRAPRKKGCWKCGKEGHQMKDCIERQANFLGKIWPSHKGRPGNFPQSRPEPTAPPEESFRFGEETTTPPPKQEPIDKGLYPSVSLKSLFGNDPLSQ

SEQ ID NO: 268 - protein, 500 aa, Human immunodeficiency virus
MGARASVLSGGKLDTWEKIRLRPGGKKQYKLKHIVWASRELERFALNPGLLETSEGCKQILEQLQPALQTGTEELRSLFNTVATLYCVHQRIDVKDTKEALDKIEEMQSKSKKPTQQAAADTGNSRQVSQNYPIVQNLQGQMVHQALSPRTLNAWVKVIEEKAFSPEVIPMFTALSEGATPQDLNTMLNTVGGHQAAMQILKETINEEAAEWDRLHPVQAGPVAPGQMRDPRGSDIAGTTSTLQEQIGWMTHNPPIPVGDIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTNSTAVMMQRGNFKNQRKPVKCFNCGREGHIARNCKAPRKKGCWKCGKEGHQMKDCTERQANFLGKIWPSHKGRPGNFLQSRPEPTAPPAESFGFGEETTTPSQKQEPIDKEQYPLTSLRSLFGNDPSSQ

SEQ ID NO: 269 - protein, 508 aa, Human immunodeficiency virus
MGARASILSGGALDKWEKIRLRPGGKKRYQFKHIIWASRELERFALNPGLLETAEGCRQILGQLQPSLQTGTEELRSLYNTVAVLYCVHQRIDVKDTKEAIEKIEEEQNKSKKKAQQAAAAAADTGNSSTGNNSKVSQNYPIVQNLQGQMVHQPISPRTLNAWVKVVEEKAFSPEVIPMFTALSEGATPQDLNTMLNTVGGHQAAMQMLKETINEEAAEWDRLHPVQAGPVAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCRTILKALGPAATLEEMMTACQGVGGPGHKARVLAEAMSQVTNSNTVMMQKGNFKNQRKTVKCFNCGKEGHIARNCRAPRKRGCWKCGKEGHQMKDCTERQANFLGKIWPSHKGRPGNFLQSRPEPSAPPAESFRFGEETTTPPQKQEPMDKELYPLASLRSLFGNDPSSQ

SEQ ID NO: 270 - protein, 504 aa, Human immunodeficiency virus
MGARASVLSGGELDKWEKIRLRPGGKKQYRLKHIVWASRELERFAVNPGLLETSNGCRQILGQLQPSLQTGSEELRSLYNTVATLYCVHQKIDVRDTKEALEKIEEEQTKSKKKAQQAAAAADTGNSSQGVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQATGAATILMQRGNFRNQRKNVKCFNCGKEGHIARNCRAPRKKGCWKCGKEGHQMKDCTERQANFLGKIWPSHKGRPGNFLQNRPEPTAPPEESFRFGEETMTPPQKKQEPTDKELYPLASLRSLFGNDPSSQ

SEQ ID NO: 271 - protein, 505 aa, Human immunodeficiency virus
MGARASVLSGGDLDKWERIRLRPGGRKKYQLKHIVWASRELERFAVNPGLLETSGGCRQILTQLQPSLQTGSEELKSLYNTVATLYCVHQKIDVKDTKEALDKIEEEQNKSKKKAQQAAANTGAAAATGTSSQDSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNSATIMMQRGNFRSQRKIVKCFNCGKEGHIARNCRAPRKKGCWKCGKEGHQMKDCTNERQANFLGKIWPSHKGRPGNFLQSRPEPTAPPAESFRFGEETTATAPPQKQEELYPLASLRSLFGNDPLSQ

SEQ ID NO: 272 - protein, 505 aa, Human immunodeficiency virus
MGARASVLSGGKLDKWEKIRLRPGGRKKYHLKHIVWASRELERFAVNPGLLETSEGCRQILGQLQPSLQTGTEELRSLYNTIATLYCVHQGVDVKDTKEALEKVEEEQNKSKKKAQQAAADAGNSSSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGDIYKRWIILGLNKIVRMYSPTSILDIKQGPKEPFRDYVDRFYKVLRAEQASQDVKNWMTETLLVQNANPDCKTILKALGPAATLEEMMTACQGVGGPGHKARVLAEAMCLVTSPATIMMQKGNFRNQRRPVKCFNCGKEGHIARNCRAPRKRGCWKCGQEGHQMKDCTERQANFLGKLWPSHRGRPGNFLQSRPEPTAPPEESFRFGEETITPSQKQEPPQKQEPEELYPLASLRSLFGNDPSSQ

SEQ ID NO: 273 - protein, 499 aa, Human immunodeficiency virus
MGARASVLSGGELDRWEKIRLRPGGKKRYKLKHIVWASRELERFAVNPGLLETSEGCRQILGQLQPSLQTGSEELKSLFNTVAVLYCVHQRIEIKDTKEALDKIEEEQNKSKKKAQQAAADTGNSSQVSQNYPIVQNLQGQMVHQPISPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIAWMTNNPPIPVGDIYKRWIILGLNKIVRMYSPSSILDIRQGPKEPFRDYVDRFYKTLRAEQASQDVKNWMTETLLVQNANPDCKTILKALGPGATLEEMMTACQGVGGPGHKARVLAEAMSQVTNSTNVMMQRGNFRNQRKPVKCFNCGKEGHIARNCRAPRKKGCWKCGKEGHQMKDCTERQANFLGKIWPSHKGRPGNFLQSRPEPTAPPEESLRFGEETTPSQKQGTIDKELYPWTSLKSLFGNDPSSQ

SEQ ID NO: 274 - protein, 502 aa, Human immunodeficiency virus
MGARASVLSGGELDRWEKIRLRPGGKKQYKLKHIVWASRELERFAVNPGLLETSEGCRKILEQLQPSLQTGSEELKSLFNTVAVLYCVHQKIDVRDTKEALDKIEEEQNKSKKKAQQAAAGTGNSSSSQASQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQKKMVKCFNCGKEGHIARNCRAPRKKGCWKCGREGHQMKDCTERQANFLGKIWPSHKGRPGNFLQSRPEPTAPPEESFRFGEETTTPSQKQEPIDKEMYPLASLKSLFGNDPSSQ

SEQ ID NO: 275 - protein, 498 aa, Human immunodeficiency virus
MGARASVLSGGKLDRWEKIRLRPGGKKQYKLKHIVWASRELERFALNPGLLETSEGCRQILRQLQPSLQTGSEELKSLFNTVATLYCVHQNIDVRDTKEALDKIEEEQNKSKKKAQQAAADTGDSSKVSQNYPIVQNLQGQMVHQAISPRTLNAWVKVIEEKAFSPEIIPMFSALSEGATPQDLNTMLNTVGGHQAAMQMLKETINEEAADWDRLHPVQAGPVAPGQIRDPRGSDIAGTTSTLQEQIAWMTNNPPIPVGEIYKRWIILGLNKIVRMYSPVSILDIKQGPKEPFRDYVDRFYKTLRAEQATQEVKNWMTETLLVQNANPDCKTILKALGQGATLEEMMTACQGVGGPGHKARVLAEAMSQVTNSANIMMQRGNFKNQRRIIKCFNCGKEGHISKNCRAPRKKGCWKCGKEGHQMKDCTERQANFLGKIWPSHKGRPGNFLQSRPEPTAPPEESFREETTTLSQKQEPIDKEMYPLASLKSLFGNDPLSQ

SEQ ID NO: 276 - protein, 500 aa, Human immunodeficiency virus
MGARASVLRGEKLDDWERIRLRPGGNKKYQLRHIVWASRELERFALNPGLLETAAGCRQIITQLQPSIQTGSEEIKSLYNTVATLYCVHERIKVADTKEALDRIEEEQAKSKKKAQQATADAKDSSQVSQNYPIVQNLQGQMVHQAISPRTLNAWVKVIEEKAFSPEVIPMFSALSEGATPQDLNTMLNTVGGHQAAMQMLKETINEEAAEWDRLHPAQAGPVAPGQIRDPRGSDIAGTTSTLQEQITWMTNNPPIPVGEIYKRWIILGLNKIVRMYSPVSILDIRQGPKEPFRDYVDRFYKTLRAEQASQDVKNWMTETLLVQNANPDCKTILKAMGPGASLEEMMTACQGVGGPGHKARVLAEAMSQVTNTGAAMMMQRGNFKGPKRIIKCFNCGKEGHIAKNCRAPRKKGCWKCGKEGHQMKECTERQANFLGRIWPSHKGRPGNFLQNRLEPTAPPAESFGFGEEIVPSQKQEQKDKELYPLTSLKSLFGNDPMSQ

SEQ ID NO: 277 - protein, 503 aa, Human immunodeficiency virus
MGARASVLSGGELDRWEKIRLRPGGKKKYKLKHIVWASRELERFAVNPGLLETSEGCRKILGQLQPSLQTGSEELKSLFNTVATLYCVHQKIDVKDTKEALEKVEEEQNKSKKKAQQEAAADTRNRSQVSQNFPIVQNLQGQMVHQPISPRTLNAWVKVVEEKAFSPEVIPMFSALSEGATPQDLNVMLNTVGGHQAAMQMLKETINDEIADWDRLHPVQAGPHPAGQLREPRGTDIAGTTSTLQEQIAWMTHNPPIPVGEIYKRWIILGLNKIVRMYSPVSILDIRQGPKEPFRDYVDRFYKVLRAEQASQDVKNWMTETLLVQNANPDCKSILKALGPAASLEEMMTACQGVGGPSHKARVLAEAMSQANSNTIMMQRGNFKNQRRTVKCFNCGKEGHIAKNCRAPRKKGCWKCGKEGHQMKDCTERQANFLGKIWPSHKGRPGNFLQSRPEPTAPPAPPEESFRFGEETTTPSQKQEPRDKELYPLASLRSLFGNDPSSQ

SEQ ID NO: 278 - protein, 499 aa, Human immunodeficiency virus
MGARASILSGGKLDHWEKIRLRPGGRKKYRLKHIVWASRELERFAVNPGLLETSDGCRQILGQLHPSLQTGSEELRSLYNTIAVLYCVHQRIEIKDTKEALEKIEEEQNKSKKKAQPVAADTGSNSKVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVNSNNIMMQRGNFRDQRKKVKCFNCGKEGHIAKNCRAPRKKGCWKCGKEGHQMKDCTERQANFLGKIWPSHKGRPGNFLQSRPEPTAPPEESFRFGEETTNPPQKQEPIDKELYPSISLKSLFGNDPSSQ

SEQ ID NO: 279 - protein, 502 aa, Human immunodeficiency virus
MGARASVLSGGKLDKWEKIRLRPGGKKRYKLKHIVWASRELERFAVNPGLLETSEGCRQILAQLQPALQTGTEELRSLFNTVATLYCVHQKIEVKDTKEALEKVEEEQNKSKKKAQQTAAAADTGESSKVSQNYPIVQNLQGQMVHQALSPRTLNAWVKVIEERAFSPEVIPMFTALSEGATPQDLNTMLNTVGGHQAAMQMLKETINEEAAEWDRLHPVHAGPVAPGQMREPRGSDIAGTTSNLQEQIGWMTSNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNSANIMMQRGNFRNQRKAVKCFNCGKEGHIARNCRAPRKKGCWKCGKEGHQMKDCTERQANFLGKIWPSHKGRPGNFLQSRPEPTAPPEESFRFGEETTTPSQKQEPIDKEMYPLTSLRSLFGNDPSSQ

SEQ ID NO: 280 - protein, 500 aa, Human immunodeficiency virus
MGARASVLSGGELDKWEKIRLRPGGKKRYKLKHIVWASRELERFAVNPGLLETAEGCRQILGQLQPALQTGSEELKSLWNTVATLYCVHQKIDVKDTKEAVDKIEEEQNKSKKKAAQQAAAGTGNSSQVSQNYPIVQNIQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIKQGPKEPFRDYVDRFYKTLRAEQCTQEVKNWMTETLLVQNSNPDCKTILKALGPAATLEEMMTACQGVGGPGHKARVLAEAMSQVNSTTIMMQRGNFKNQRKNIKCFNCGKEGHLARNCRAPRKRGCWKCGEEGHQMKDCTGRQANFLGKIWPSHKGRPGNFLQSRPEPTAPPAESFRFGEETTTPSQKQEPTDKEMYPLASLKSLFGNDPSSQ

SEQ ID NO: 281 - protein, 500 aa, Human immunodeficiency virus
MGARASVLSGGELDRWEKIRLRPGGKKKYKLKHIVWASRELERFAVNPGLLETSAGCRQILEQLQPALQTGSEELKSLHNAVAVLYCVHQRIDVKDTKEALDKIEEERNKSKKKEQQATADTGNSNQVSQNYPIVQNLQGQMVHQTMSPRTLNAWVKVIEEKAFSPEVIPMFSALSEGATPQDLNTMLNTVGGHQAAMQMLKETINEEAAEWDRLHPVQAGPVAPGQLREPRGSDIAGTTSTLQEQIAWMTHNPPIPVGEIYKRWIILGLNKIVRMYSPTSILDIRQGPKEPFRDYVDRFYKTLRAEQASQEVKNWMTETLLIQNANPDCKTILKALGPGATLEEMMTACQGVGGPSHKARVLAEAMSQATGSATIMMQRGNFKNQRKIIKCFNCGKEGHIAKNCRAPRKKGCWKCGKEGHQMKDCTERQANFLGKIWPSHKGRPGNFLQSRPEPTAPPEENFRFGEETTTPSQKQEPTDKEQYPLAALRSLFGNDPSSQ

SEQ ID NO: 282 - protein, 506 aa, Human immunodeficiency virus
MGARASVLSGGQLDRWERIRLRPGGKKKYRLKHLVWASRELERFALNPGLLETSEGCRQILGQLQPSLQTGSEEIKSLFNTVATLYCVHQKIDVKDTKEALDKIEEEQNKSKKKTQQAAADTGNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQMTNSATIMMQKGNFRNQRKIVKCFNCGKEGHIARNCRAPRKKGCWKCGKEGHQMKDCNERQANFLGKIWPSSKGRPGNFPQSRLAPQSRLEPTAPPEESFRIGEETATPSQKQEQIDREMPPLTSLRSLFGNDPSSQ

SEQ ID NO: 283 - protein, 499 aa, Human immunodeficiency virus
MGARASVLSGGELDRWEKIRLRPGGKKKYKLKHIVWASRELERFAVNPGLLETSEGCRQIIGQLQPSLQTGSEELRSLYNTVATLYCVHQRIEIKDTKEALDKIEEEQNKSKKKAQQAAADTGNSSQVSQNYPIVQNMQGQMVHQAISPRTLNAWVKVVEEKAFSPEVIPMFSALSEGATPQDLNTMLNTVGGHQAAMQMLKETINEEAAEWDRLHPPQAGPIAPGQIREPRGSDIAGTTSTLQEQITWMTNNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQASQATIMMQRGNFRNQRRTVKCFNCGKEGHIAKNCRAPRKKGCWKCGKEGHQMKDCTERQANFLGKIWPSHRGRPGNFLQNRPEPSAPPEESFRFGEETTTPSQKQEPIDKELYPLTSLKSLFGNDPLSQ

SEQ ID NO: 284 - protein, 500 aa, Human immunodeficiency virus
MGARASVLSGGKLDKWEKIRLRPGGKKKYQLKHLVWASRELERYALNPGLLETSEGCRQILRQLQPALQTGTEEIKSLYNAVATLYCVHQGIDVRDTKEALDKIEEEQNKSKKETQQAAADTENNSKVSQNYPIVQNLQGQMVHQPISPRTLNAWVKVVEEKAFSPEVIPMFSALSEGATPQDLNTMLNTVGGHQAAMQMLKETINEEAAEWDRLHPVQAGPVAPGQMREPRGSDIAGTTSNLQEQVAWMTGNPAIPVGEIYKRWIILGLNKIVRMYSPTSILDIRQGPKEPFRDYVDRFYRTLRAEQASQDVKNWMTETLLVQNANPDCKTILKALGPGATLEEMMTACQGVGGPSHKARVLAEAMSQVNSANANVMMQRSNFKNQRRIVKCFNCGKEGHIAKNCRAPRKKGCWKCGKEGHQMKDCTERQANFLGKIWPSHKGRPGNFPQSRTEPTAPPEEIFGFGEEATPSQKQESIDKEKYPLSSLRSLFGNDPSSQ

SEQ ID NO: 285 - protein, 506 aa, Human immunodeficiency virus
MGARASILSGGGLDRWEKIRLRPGGKKKYRLKHLVWASRELERFAVNPGLLETAEGCKQILEQLQPSLKTGSEEIKSLYNTVATLYCVHNKIEVRDTKEALDKIEEEQNKSKKKAQQAAADTGNSSHTGDNSQVSHNYPIVQNMQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIKQGPKEPFRDYVDRFYKVLRAEQASQEVKNWMTETLLVQNSNPDCKTILKALGPGATLEEMMTACQGVGGPAHKARVLAEAMSQATNAAAIMMQKGNYGNQKKIVKCFNCGKIGHIAKHCKAPRKRGCWKCGKEGHQMKDCTERQANFLGKIWPSYKGRPGNFLQNRPEPSAPPEESFKFGEETTTPPQKQEPIDKELYPLASLKSLFGNDPLSQ

SEQ ID NO: 286 - protein, 501 aa, Human immunodeficiency virus
MGARASILRGGELDRWEKIRLRPGGKKKYRLKHLVWASRELERFAVNPGLLESSEGCRKILEQLQPSLQTGSEELRSLYNTIATLYCVHQKIEIRDTKEALDKIEEEQNKSKKKAQQAAADTGNKSQVSQNYPIVQNLQGQMVHQALSPRTLNAWVKVIEEKAFSPEVIPMFSALSEGATPQDLNTMLNTVGGHQAAMQILKETINEEAADWDRTHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPGATLEDMMTACQGVGGPSHKARVLAEAMSQVTNSATNVMMQRGNFRSQRRTVKCFNCGKEGHIAKNCRAPRKKGCWKCGKEGHQMKDCTERQANFLGKIWPSHKERPGNFLQSRPEPSAPPAESFRFGEETATPPQKQEPIDQELYPLASLKSLFGNDPSSQ

SEQ ID NO: 287 - protein, 503 aa, Human immunodeficiency virus
MGARASVLSGGELDRWEKIRLRPGGKKKYKLKHIVWASRELERYSLNPGLLETSEGCRQILGQLQPALQTGSEELRSLFNTIATLYCVHQRIDVKDTKEALDKIEEEQNKSKKKAQQATAADTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIKQGPKEPFRDYVDRFYKTLRAEQASQDVKNWMTETLLVQNANPDCKTILKALGPAATLEEMMTACQGVGGPGHKARILAEAMSQVTNSNVIMMQRGNFRNQRKTIKCFNCGKEGHLARNCRAPRKKGCWKCGKEGHQMKECTERQANFLGKIWPSHKGRPGNFLQSRPEPTAPPEESFRFGEETTTTPSQKQEPVDKELYPPLASLRSLFGNDPSSQ

SEQ ID NO: 288 - protein, 501 aa, Human immunodeficiency virus
MGARASVLSGGELDRWEKIRLRPGGHKKYRLKHIVWASRELERFAINPGLLETSEGCKQILGQLQPSLQTGSEELRSLFNTIATLYCVHQKIEIKDTKEALEKIEEEQNKCKKKAQQAAADTQKSSQVSQNFPIVQNLQGQMVHQAISPRTLNAWVKVIEEKAFSPEVIPMFTALSEGATPQDLNTMLNTVGGHQAAMQMLKETINEEAAEWDRLHPVHAGPVAPGQMREPRGSDIAGTTSTLQEQIAWMTSNPPVPVGEIYKRWIILGLNKIVRMYSPTSILDIKQGPKEPFRDYVDRFYKTLRAEQASQEVKNWMTETLLVQNANPDCKTILKALGPGATLEEMMTACQGVGGPGHKARVLAEAMSQVTNSSAIMMQRGNFRGQRKIVKCFNCGKEGHIAKNCRAPRKKGCWKCGKEGHQMKDCTERQANFLGKIWPSHKGGRPGNFLQSRPEPTAPPEESFRYGEGTIAPPQKQEQIDKELYPLTSLRSLFGNDPSSQ

SEQ ID NO: 289 - protein, 503 aa, Human immunodeficiency virus
MGARASVLSGGELDRWERIRLRPGGKKKYRLKHIVWASRELERFAVNPGLLETSEGCRQILGQLQPSLQTGSEELRSLFNTIATLYCVHQKIDVKDTKEALDKIEEEQNKSKKKAQQAAAAAADTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIIMGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKIVKCFNCGKEGHIARNCRAPRKKGCWKCGREGHQMKDCTERQANFLGKIWPSHKGRPGNFLQSRPEPTAPPEESFRFGEETATPSQKQEPTDKELYPLVSLKSLFGNDPSSQ

SEQ ID NO: 290 - protein, 500 aa, Human immunodeficiency virus
MGARASVLSGGKLDKWEKIRLRPGGKKKYKLKHIVWASRELERFAVNPGLLETAEGCKQIMEQLQPALQTGTEELRSLFNTIATLYCVHQRIEIKDTKEALEKVEEEQNKSKKKAQQPAADTGSSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVKMYSPTSILDIRQGPKEPFRDYVDRFYRTLRAEQASQEVKNWMTETLLVQNANPDCKTILKALGPAATLEEMMTACQGVGGPGHKARVLAEAMSQVTNSAAVMMQKGNFKNQRKAVKCFNCGKEGHIARNCRAPRKKGCWKCGREGHQMKECTERQANFLGKIWPSHKGRPGNFLQSRPEPTAPPVESFRFGEETTAPPQKQEPTDKELHPLASLRSLFGNDPSSQ

SEQ ID NO: 291 - protein, 507 aa, Human immunodeficiency virus
MGARASVLSGGKLDKWEKIRLRPGGKKRYKLKHIVWASRELERFAVNPGLLESAGGCRQILEQLQPSLQTASEELRSLYNMVATLYCVHQQIEVRDTKEALDKIEEEQNKSKKKAQQTAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMRKPRGSDIAGTTSTLQEQIAWMTNNPPIPVGEIYKRWIIMGLNKVVRMYSPTSILDIRQGPKEPFRDYVDRFYKTLRAEQASQEVKNWMTETLLVQNSNPDCKTILKALGPAATLEEMMTACQGVGGPGHKARVLAEAMSQANSASIMMQKGNFKNQGKIVKCFNCGKAGHIARNCRAPRKKGCWKCGKEGHQMKDCSNERQANFLGKIWPSHKGRPGNFLQNRPEPSAPPEPSAPPEESFRFGEGTTTPSQKQETTDKDLYPPLASLKSLFGNDPSSQ

SEQ ID NO: 292 - protein, 496 aa, Human immunodeficiency virus
MGARASIISGGKLDKWEKIRLRPGGRKKYKLKHIIWASRELERYALNPGLLETSEGCKQIIGQLQPALQTGSEEFRSLYNTIAVLYCVHQRIEVKDTKEALDKIEEEQNKSKKRAQQAAADTGNSPVSQNYPIVQNLQGQMVHQAISPRTLNAWVKVVEEKAFSPEVIPMFSALSEGATPQDLNTMLNTVGGHQAAMQMLKETINEEAAEWDRLHPPQAGPHPPGQLREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTTPPAIMMQRGNFRNQGKTVKCFNCGKVGHIAKNCRAPRKKGCWKCGKEGHQMRDCIEGQANFLGKIWPSHKGRPGNFLQSRPEPSAPPEESFRFGEETATPPQKQESIDKEKYPLASLKSLFGNDP

SEQ ID NO: 293 - protein, 506 aa, Human immunodeficiency virus
MGARASVLSGGELDKWEKIRLRPGGKKKYKLKHIVWASRELERFAVNPGLLETSQGCRQILGQLQPSLQTGSEELKSLFNTIAVLYCVHQRIEVKDTKEALDKIEEEQNKSKKKAQPAAAAADTGNNSNVSQNYPIVQNLQGQMIHQAISPRTLNAWVKVVEEKAFSPEVIPMFSALAEGATPGDLNLMLNAVGGHQAAMQMLKETINEEAADWDRQHPVQAGPVAPGQIREPRGSDIAGTTSTLQEQIAWMTANPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTNSTAIMMQRGNFRNQRKSIKCFNCGKEGHLARNCRAPRKKGCWKCGKEGHQMKDCTERQANFLGKIWPSHKGRPGNFLQSRPEPTAPPAPTAPPEESFRFVEETTTPSPKQEQRDKELYPPLASLRSLFGSDP

SEQ ID NO: 294 - protein, 503 aa, Human immunodeficiency virus
MGARASVLSGGELDRWEKIRLRPGGRKKYRLKHIVWASRELERFAVNPGLLETSEGCRQILGQLQPSLQTGSEELRSLYNTIATLYCVHQKIDVKDTKEALEKIEEEQNKSKKRAQQAAAAAADTGNSSQVSHNYPIVQNMQGQMVHQPISPRTFKAWVKVIEENVFLFGLIPMFTALSEGATPQDLNTMLNTVGGHQAAMQMLKETINEEAAEWDRLHPAQAGPIAPGQIREPRGSDIAGTTSTLQEQITWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSAAIMMQKGNFRNQRRSVKCFNCGKEGHIAKNCRAPRKKGCWKCGKEGHQMKDCTERQANFLGKIWPSHKGRPGNFLQSRPEPTAPPEESFRFGEETTTPPQKQEPIDKELYPLASLKSLFGNDPSSQ

SEQ ID NO: 295 - protein, 502 aa, Human immunodeficiency virus
MGARASVLSGGELDRWEKIRLRPGGKKQYKLKHIVWASRELERFALNPSLLETAEGCKQILGQLQPSLQTGSEELKSLHNTVAVLYCVHQRIAIKDTKEALDKIEEEQNKCKKKAQQAQQAAADTGNSSQVSQNYPIVRNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTSNPPIPVGDIYKQWIIMGLNKIVRMYSPTSILDIKQGPKEPFRDYVDRFYKTLRAEQASQEVKNWMTETLLVQNSNPDCKTILKALGPAATLEEMMTACQGVGGPGHKARVLAEAMSQVTNAATIMMQKGNFRGQRKPVKCFNCGKEGHIARNCRAPRKRGCWKCGKEGHQMKDCTERQANFLGKIWPSHKGRPGNFLQNRPEPSAPPAESFRFGEETAAPSQKQEQIDKELYPTTSLRSLFGNDPSL

SEQ ID NO: 296 - protein, 499 aa, Human immunodeficiency virus
MGARASVLSGGELDKWEKIRLRPGGKKKYKLKHIVWASRELERFAVNPGLLETSQGCRQILGQLQPSLQTGSEELKSLYNTVAVLYCVHQRIEVKDTKEALEKIEEEQNKSKKKAQPAAAAADTGNNSNVSQNYPIVQNLQGQMVHQAISPRTLNAWVKVVEEKAFSPEVIPMFSALAEGATPGDLNLMLNTVGGHQAAMQMLKETINEEAADWDRQHPVHAGPIAPGQMREPRGSDIAGTTSTLQEQVAWMTANPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQITNPTAIMMQRGNFKNQRKIIKCFNCGKEGHIAKNCRAPRKKGCWKCGKEGHQMKDCIERQANFLGKIWPSHKGRPGNFLQSRPEPTAPPEESFRFVEETTTPPQKQEPTDKELYPLASLKSLFGNDP

SEQ ID NO: 297 - protein, 508 aa, Human immunodeficiency virus
MGARASVLSGGDLDRWEKIRLRPGGKKRYQLKHIVWASRELERFAVNPGLLETSNGCRQILAQLQSSLQTGSEELKSLYNTVATLYCVHQKIDIKDTKEALDKIEEEQNKSKKKAQQAAAAAADTGNNSQISQNYPIVQNMQGQMVHQAISPRTLNAWVKVVEEKAFSPEVIPMFTALSEGATPQDLNTMLNTVGGHQAAMQMLKETINEEAAEWDRLHPVHAGPVAPGQMREPRGSDIAGTTSTLQEQVAWMTGNPGVPVGDIYKRWIIMGLNKIVRMYSPTSILDIKQGPKEPFRDYVDRFYKTLRAEQASQDVKNWMTETLLVQNANPDCKTILKAMGPGATLEEMMTACQGVGGPGHKARVLAEAMSQVNSNAIMMQRGNFRGQRRTVKCFNCGKEGHIAKNCRAPRKKGCWKCGKEGHQMKDCTNERQANFLGKIWPSHKGRPGNFLQSRPGPTALEPTAPPEESIRFGEGTTTSSQKQEPRDKELYPLTSLKSLFGNDPSSQ

SEQ ID NO: 298 - protein, 510 aa, Human immunodeficiency virus
MGARASVLSGGKLDKWEKIRLRPGGKKKYQLKHIVWASRELERFAVNPGLLETSEGCRQILGQLQPSLQTGSEELKSLFNTIATLYCVHQGIEIRDTKEALDKIEEEQNKSKKEAQQAAAATGNNSQVSQNYPIVQNLQGQMVHQAISPRTLNAWVKVIEEKAFSPEVIPMFSALAEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPVSILDIRQGPKEPFRDYVDRFYKTLRAEQASADVKNWMTETLLVQNANPDCKTILKALGPAATLEEMMTACQGVGGPSHKARVLAEAMSLATNPAAIMMQKGNFKSPRKGVKCFNCGKEGHIAKNCRAPRKRGCWKCGKEGHQMKDCTERQANFLGKIWPSYKGRPGNFLQSRPEPTAPPEESLRPTAPPAESLRFGEETTTPSQKQGTIDKELYPLTSLRSLFGNDPSSQ

SEQ ID NO: 299 - protein, 501 aa, Human immunodeficiency virus
MGARASVLSGGELDKWEKIRLRPGGRKQYKLKHIVWASRELERFALNPGLLETSEGCRQILGQLQPSLQTGSEELRSLFNTIAVLYCVHQRIEVKDTKEALEKIEEEQNKSKKKAQQAAADIGKNNQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPSHKARVLAEAMSQATNTAASIMMQRGNPKTQRKIVKCFNCGKIGHIARNCRAPRKRGCWKCGKEGHQMKDCNEGQANFLGKIWPSHKGRPGNFLQSRPEPTAPPEESFRFGEETATPSQKQEPKDKELYPLASLRSLFGNDPSSQ

SEQ ID NO: 300 - protein, 506 aa, Human immunodeficiency virus
MGARASVLSGGQLDKWEKIRLRPGGKKAYKLKHIVWASRELERFAVNPGLLETAEGCRQILEQLQPALKTGSEELRSLFNTVAVLYCVHQRIDVKDTKEALDKIEEEQNKSKKKAQQAQPAAADTGNNNQVSQNYPIVQNAQGQMVHQGISPRTLNAWVKVIEEKAFSPEVIPMFSALSEGATPQDLNTMLNTVGGHQAAMQMLKDTINEEAADWDRMHPVHAGPIAPGQMREPRGSDIAGTTSTLQEQIQWMTNNPPIPVGEIYKRWIIIGLNKIVRMYSPVSILDIKQGPKEPFRDYVDRFYKTLRAEQASQEVKNWMTETLLVQNANPDCKSILKALGPAATLEEMMTACQGVGGPSHKARVLAEAMSQVTNSAAIMMQNSNFKNQRKIVKCFNCGKEGHIARNCRAPRKKGCWKCGREGHQMKDCTERQANFLGKIWPSHKGRPGNFLQNRPEPTAPPAPPEESFRFGEETAAPSQQQGTMDKDLYPLASLKSLFGNDPSSQ

SEQ ID NO: 301 - protein, 506 aa, Human immunodeficiency virus
MGARASVLSGGELDKWERIRLRPGGKKKYRLKHIVWASRELERFAVNPGLLETSEGCRQILGQLQPSLQTGSEELRSLYNTIATLYCVHQRIDVKDTKEALEKIEEEQNKSKKKAQQAAAAADTGTGNNSKVSQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTGILDIRQGPKESFRDYVDRFYKTLRAEQASQEVKNWMTETLLVQNANPDCKTILKALGPAATLEEMMTACQGVGGPGHKARVLAEAMSHVTNPVNIMMQRGSFRNQRRMVKCFNCGKEGHIAKNCRAPRKKGCWKCGKEGHQMKDCNERQVNFLGKIWPSHKGRPGNFLQNRPEPSAPPAESLGFGEEATTPPQKQETMTVDKELYPLTSLRSLFGSDPSSQ

SEQ ID NO: 302 - protein, 501 aa, Human immunodeficiency virus
MGARASILSGGKLDKWEKIRLRPGGKKQYKLKHLVWASRELERFAVNPGLLETSEGCRQILGQLHPSLQTGSEELKSLYNTVATLYCVHQNIEVRDTKEALDKIEEEQNKSKKKAQQAAAADTGNSGQVSQNYPIVQNIQGQMVHQALSPRTLNAWVKVVEEKAFSPEVIPMFAALSEGATPGDLNTMLNTVGGHQAAMQMLKETINEEAAEWDRTHPVHAGPVAPGQLREPRGSDIAGTTSTLQEQIAWMTHNPPIPVGEIYKKWIILGLNKIVRMYSPSSILDIKQGPKEPFRDYVDRFYKTLRAEQASQEVKNWMTETLLVQNANPDCKTILKALGPAATLEEMMTACQGVGGPGHKARVLAEAMSQLTNSATIMMQKGNFRNQKRTIKCFNCGKEGHLARNCRAPRKKGCWKCGKEGHQMKDCIERQANFLGRIWPSHKGRPGNFLQSRPEPSAPPAESFGFGEETTTPSQKQELIDKEQYPLTSLRSLFGNDPSSM

SEQ ID NO: 303 - protein, 502 aa, Human immunodeficiency virus
MGARASVLSGGELDQWEKIRLRPGGKKKYKLKHIVWASRELERFAVNPGLLETSEGCRQILEQLQPALQTGSEELRSLFNTVATLYCVHKRIEVKDTKEALEKIEEEQNKSKKKAQQAAVAADAGTSNQVSQNYPIVQNIQGQMVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIIMGLNKIVRMYSPTSILDIKQGPKEPFRDYVDRFYKTLRAEQASQEVKNWMTETLLVQNANPDCKTILKALGPGATLEEMMTACQGVGGPSHKARVLAEAMSQVTNSATIMMQTGKFRNQRKTVKCFNCGKEGHIARNCRAPRKRGCWKCGKEGHQMKDCTERQANFLGKIWPSHKGRPGNFLQSRPEPTAPPEESFRFGEEITTPSQKQELTDKEMYPLTSLRSLFGNDPSSQ

SEQ ID NO: 304 - protein, 501 aa, Human immunodeficiency virus
MGARASVLSGGKLDKWEKIRLRPRGKKRYKLKHIVWASRELERFAVNPSLLETAEGCRQILGQLQPALQTGSEELKSLYNAVATLYCVHQNIEVRDTKEALDKIEEEQNKSKKKAQQAAADTGNGSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIRQGPKEPFRDYVDRFYKTLRAEQASQDVKNWMTETFLVQNANPDCKTILKALGPAATLEEMMTACQGVGGPSHKARILAEAMSQVTNSATIMLQKGNFRDQRKIVKCFNCGKVGHIAKNCRAPRKKGCWKCGKEGHQMKDCTNEGRQANFLGKIWPSHKGRPGNFLQSRPEPTAPPEESFRFGEETTPSQKQEKIDKELYPLASLKSLFGNDPSSQ

SEQ ID NO: 305 - protein, 506 aa, Human immunodeficiency virus
MGARASVLSGGELDRWENIRLRPGGKKKYKLKHVVWASRELERFAVNPGLLETSEGCRQILGQLQPSLQTGSEELKSLYNTVATLYCVHQKIEIKDTKEALEKIEEEQNKSKKKAQQAAADTGNRGNSSQVSQNYPIVQNIEGQMVHQAISPRTLNAWVKVVEEKAFSPEVIPMFSALSEGATPQDLNTMLNTVGGHQAAMQMLKETINEEAAEWDRLHPVHAGPITPGQMREPRGSDIAGTTSTLQEQIGWMTNNPPIPVGEIYKRWIILGLNKIVRMYSPSSILDIRQGPKEPFRDYVDRFYKTLRAEQASQEVKNRTTETLLVQNANPDCKTILKALGPAATLEEMMTACQGVGGPGHKARVLAEAMSQVTNSATIMMQRGNFRNQRKIIKCFNCGKEGHIAKNCRAPRKRGCWKCGKEGHQMKDCTERQANFLGKIWPSCKGRRNFPQSRTEPTAPPEESFRFGEETTTPYQKQEKKQETIDKDLYPLASLKSLFGNDPLSQ

SEQ ID NO: 306 - protein, 500 aa, Human immunodeficiency virus
MGARASVLSGGELDKWEKIRLRPGGKKQYRLKHIVWASRELERFAVNPGLLETSEGCRQILRQLQPSLQTGSEERRSLFNTVAVLYCVHQRIDVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPATIMIQRGNFRNQKKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGSDPSSQ

SEQ ID NO: 307 - protein, 503 aa, Human immunodeficiency virus
MGARASVLSAGELDKWEKIRLRPGGRKKYKLKHIIWASRELERFAVNPGLLETSEGCRQILGQLQPSLQTGSEELRSLFNTVATLYCVHQKIEVKDTKEALEKVEEEQNKSKKKAQQAAADTGKGSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQIREPRGSDIAGTTSTLPEQIGWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPATIMMQRGNFRNQKKPIKCFNCGKEGHLAKNCRAPRKKGCWKCGKEGHQMKDCTERQANFLGKIWPSHKGRPGNFLQSRPEPTAPPAPPEESFRFGEETITPSQKQESIDKELYPLASLKSLFGNDPSSQ

SEQ ID NO: 308 - protein, 500 aa, Human immunodeficiency virus
MGARASVLSGGELDRWEKIRLRPGGKKKYRLKHIVWASRELERFAVNPGLLETSEGCRQILGQLQPALQTGSEELRSLYNTVATLYCVHQRIEIKDTKEALDKIEEEQNKSKKKAQPAAADTGNSTQVSQNYPIVQNMQGQMVHQALSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTHNPPIPVGEIYKRWIIMGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTSSANIMMQRGNFRNQRKTVKCFNCGKEGHIARNCRAPRKKGCWKCRKEGHQMKDCTERQANFLGKIWPSHKGRPGNFLQSRPEPSAPPEESFRFGEETTTPSQKQEPIDKEMYPLASLRSLFGNDPSSQ

SEQ ID NO: 309 - protein, 503 aa, Human immunodeficiency virus
MGARASVLSGGELDRWEKIRLRPGGKKKYRLKHIVWASRELERFAVNPGLLETSEGCRQILGQLQPSLQTGSEELRSLYNTVATLYCVHQKIEVKDTKEALDKIEEEQNKCKKKAQQAAADTGNSGQVSQNFPIVQNLQGQMVHQAISPRTLNAWVKVIEEKAFSPEVIPMFSALSEGATPQDLNTMLNTVGGHQAAMQMLKEPINEEAARWDRLHPVQAGPVAPGQIRDPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARILAEAMSQVTNSATIMMQKGNFRNQRKIVKCFNCGKEGHIARNCRAPRKRGCWKCGKEGHQMKDCTERQANFLGKIWPSHKGRPGNFLQSRPEPTAPPAPPEESFRFGEETTTPSQKQELIDKELYPLASLRSLFGNDPSSQ

SEQ ID NO: 310 - protein, 500 aa, Human immunodeficiency virus
MGARASVLSGGELDRWEKIRLRPGGKKQYELKHIVWASRELERFALNPGLLETSEGCRQILGQLQPALQTGSEELRSLYNTVATLYCVHQKIEVRDTKEALDKIEEEQNKSKKKAQQATADIGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMRDPRGSDIAGTTSTLQEQIGWMTSNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVSAEAMSQVTNSATIMMQKGNFRNQKRTVKCFNCGREGHIAKNCRAPRKKGCWKCGKEGHQMKDCTERQANFLGKIWPSHKGRPGNFLQSRPEPTAPPEESFRFGEEIATPSQKQEPIDKELYPLASLKSLFGNDPSSQ

SEQ ID NO: 311 - protein, 498 aa, Human immunodeficiency virus
MGARASVLSGGELDRWEKIRLRPGGKKTYKLKHIVWASRELERFAVNPLETSEGCRQILGQLQPSLQTGSEELRSLYNTVATLYCVHQRIEVKDTKEALDKIEEEQNKGKKKAQQAAADTGNSSTVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTSNPPIPVGEIYKRWIIMGLNKIVRMYSPTSILDIRQGPKEPFRDYVDRFYKTLRAEQASQDVKNWMTETLLVQNANPDCKTILKALGPAATLEEMMTACQGVGGPSHKARILAEAMSQVTNSATIMMQRGNVRNQRKAVKCFNCGKEGHIARNCRAPRKKGCWKCGKEGHQMKDCIERQANFLGKIWPSYKGRPGNFLQSRPEPSAPPDESFGFGEETTTPPQKQEPIDKEKYPLTSLRSLFGNDPSSQ

SEQ ID NO: 312 - protein, 500 aa, Human immunodeficiency virus
MGARASVLSGGKLDRWEKIRLRPGGKKQYRLKHIVWASRELERFAVNPGLLETAEGCKQILGQLQPALQTGSEELRSLFNTVATLYCVHQGIEVRDTKEALDKIEEEQNKSKKKAQQAAADTGNSSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYRTLRAEQASQEVKNWMTETLLVQNANPDCRTILKALGPAATLEEMMTACQGVGGPGHKARVLAEAMSQVTNSATVMMQRGNFRNQRKLVKCFNCGKEGHIARNCRAPRKRGCWKCGKEGHQMKDCTERQANFLGKIWPSHKGRPGNFLQSRPEPSAPPEESFRFGEETTTPSQKQEPIDKELYPLASLRSLFGNDPSSQ

SEQ ID NO: 313 - protein, 500 aa, Human immunodeficiency virus
MGARASVLSGGELDRWEKIRLRPGGKKKYKLKHIVWASRELERFAVNPGLLETSEGCRQILGQLQPSLQTGSEELKSFYNTIATLYCVHQKIEVKDTKEALEKIEEEQNKSKKKAQQAAADTGKGSQVSQNYPIVQNLQGQMVHQPLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIAWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 314 - protein, 500 aa, Human immunodeficiency virus
MGARASVLSGGKLDRWEKIRLRPGGKKKYKLKHIVWASRELERFAVNPGLLETSEGCRQILGQLQPSLQTGSEELKSLFNTVATLYCVHQNIDVRDTKEALDKIEEEQNKSKKKAQQAAADAEKSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRRTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLTSLKSLFGNDPSSQ

SEQ ID NO: 315 - protein, 504 aa, Human immunodeficiency virus
MGARASVLSGGELDRWEKIRLRPGGKKKYRLKHIVWASRELERFAVNPGLLESSEGCRQILGQLQPSLKTGSEELTSLYNTVATLYCVHQRIEIKDTKEALEKIEEEQTKSMKKAQQAAADTGNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNPATIMMQRGNFRNQRKNVKCFNCGKEGHIARNCRAPRKKGCWKCGKEGHQMKECTERQANFLGKIWPSYKGRPGNFLQSRPEPTAPPEESFRFGEETATPSQKQEQKQEPIDKELYPLTSLRSLFGNDPSSQ

SEQ ID NO: 316 - protein, 498 aa, Human immunodeficiency virus
MGARASVLSGGELDRWEKIRLRPGGRKKYQLKHIVWASRELERFAINPGLLETSEGCRQILGQLQPSLQTGSEELRSLYNTIATLYCVHQKIDVKDTKEALERIEEEQNKSKTQQAAADTGNSSKVSQNYPIVQNIQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKPVKCFNCGREGHIAKNCRAPRKRGCWKCGKEGHQMKDCTERQANFLGKIWPSYKGRPGNFLQSRPEPSAPPEESFRFGEETTTPAQKQEPTDKELYPLASLRSLFGNDPSSQ

SEQ ID NO: 317 - protein, 500 aa, Human immunodeficiency virus
MGARASVLSGGKLDKWEKIRLRPGGKKKYKLKHLVWASRELERFAVNPGLLETAEGCRQILGQLQPSLQTGSEELKSLYNTIAVLYCVHQMIDVKDTKEALEKIEEEQNNSKKKAQQAAADTGNSSQVSRNYPIVQNIQGQMVHQAISPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPSSILDIRQGPKESFRDYVDRFYKTLRAEQASQEVKNWMTETLLVQNANPDCKTILKALGPGATLEEMMTACQGVGGPGHKARVLAEAMSQVTNSATIMMQRGNFRNQRKTVKCFNCGKEGHIARNCKAPRKRGCWKCGKEGHQMKDCTERQANFLGKIWPSHKGRPGNFPQSRLEPTAPPEESFRFGEETTTPPQKQEREDKEMYPLASLRSLFGNDPSSQ

SEQ ID NO: 318 - protein, 500 aa, Human immunodeficiency virus
MGARASVLSGGKLDRWEKIRLRPGGKKKYKLKHLVWASRELERFAVNPGLLETSEGCRQILGQLQPSLQTGSEELKSLFNTIATLYCVHQRIEVKDTKEALEKIEEEQNKSKKKAQQTAADTGNSNQVSQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQATSSATIMIQRGNFKNQRKTVKCFNCGKEGHIARNCRAPRKKGCWKCGREGHQMKDCTERQANFLGKIWPSHKGRPGNFLQSRPEPTAPPEESFSFGEETTTPSQKQEPIDQGRYPLASLRSLFGNDPSSQ

SEQ ID NO: 319 - protein, 500 aa, Human immunodeficiency virus
MGARASVLSGGELDRWEKIRLRPGGKKKYKLKHIVWASRELERFAVNPSLLETSEGCRQILGQLQSSLQTGSEELKSLYNTVATLYCVHQRIEVKDTKEALDKIEEEQNKSKKKAQQAAADTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPSSILDIKQGPKEPFRDYVDRFYKTLRAEQASQEVKNWMTETLLVQNANPDCKTILKALGPGATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 320 - protein, 498 aa, Human immunodeficiency virus
  variant (30)..(30): Xaa can be any naturally occurring amino acid
  variant (43)..(43): Xaa can be any naturally occurring amino acid
  variant (149)..(149): Xaa can be any naturally occurring amino acid
  variant (392)..(392): Xaa can be any naturally occurring amino acid
ARASVLSGGELDRWERIRLRPGGKKKYRLXHVVWASRELERFXVNPGLLETSEGCRQILGQLQPALQTGSEELRSLYNTVATLYCVHQKIEIKDTKEALEKIEEEQNKSKKKAQQAAADTGNSSQVSQNYPIVQNLQGQMVHQALSPRXLNAWVKVVEEKAFSPEVIPMFSALSEGATPQDLNTMLNTVGGHQAAMQMLKETINEEAAEWDRLHPVQAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQITSPATIMMQKGNFRNQRKIVKCFXCGKEGHIARNCRAPRKKGCWKCGKEGHQMKECTERQANFLGKIWPSHKGRPGNFLQSRPEPTAPPEESFRFGEETITPSQKQEPIDKELYPLASLKSLFGNDPSSQ

SEQ ID NO: 321 - protein, 499 aa, Human immunodeficiency virus
MGARASVLSGGELDKWEKIRLRPGGKKQYKLKHIVWASRELERFAVNPGLLETSDGCRQILGQLQPALQTGSEELKSLYNTVATLYCVHQRIDVRDTKEALDKIEEEQNKSKKKAQQAAADTNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATVMMQRGNFRNQKKIVKCFNCGKEGHIARNCRAPRKKGCWKCGKEGHQMKDCTERQANFLGKIWPSHKGRPGNFLQSRPEPTAPPEESFRFGEETTTPSQKQETIDKEMYPLASLRSLFGNDPSSQ

SEQ ID NO: 322 - protein, 500 aa, Human immunodeficiency virus
  variant (64)..(64): Xaa can be any naturally occurring amino acid
  variant (106)..(106): Xaa can be any naturally occurring amino acid
  variant (275)..(275): Xaa can be any naturally occurring amino acid
  variant (287)..(287): Xaa can be any naturally occurring amino acid
  variant (366)..(366): Xaa can be any naturally occurring amino acid
MGARASVLSGGKLDKWEKIRLRPGGKKKYKLKHIVWASRELERFALNPGLLETSEGCRQILGQXQPALKTGSEELKSLFNTVATLYCVHQNIEVRDTKEALDKIEXEQNKSKKKAQQAAADTGSSSQVSQNYPIVQNLQGQMVHQPLSPRTLNAWVKVVEEKAFSPEVIPMFSALSEGATPQDLNTMLNTVGGHQAAMQMLKETINEEAAEWDRLHPVQAGPIAPGQIREPRGSDIAGTTSNLQEQIAWMTHNPPIPVGEIYKRWIILGLNKIVXMYSPTSILDIRXGPKEPFRDYVDRFYKTLRAEQASQEVKNWMTETLLVQNANPDCKTILKALGPAATLEEMMTACQGVGGPGHKARVLAEXMSQVTNPSTIMMQRGNFRNQKRTVKCFNCGKEGHIAKNCRAPRKKGCWKCGKEGHQMKDCTERQANFLGKIWPSHKGRPGNFLQSRPEPTAPPEESFRFGEETTNPSPKQEPIDKELYPLTSLRSLFGNDPSLQ

SEQ ID NO: 323 - protein, 499 aa, Human immunodeficiency virus
  variant (219)..(219): Xaa can be any naturally occurring amino acid
  variant (331)..(331): Xaa can be any naturally occurring amino acid
MGARASVLSGGELDKWEKIRLRPGGKKRYRLKHIVWASRELERFAVNPGLLETADGCKQIIAQLQPSLQTGSEELRSLFNTVVTLYCVHKKIEVKDTKEALEKVEEEQNKSKKKAQQAAADTGSNSPVSQNFPIVQNLQGQMVHQALSPRTLNAWVKVVEEKAFSPEVIPMFSALSEGATPQDLNTMLNTVGGHQAAMQMLKETINEEAAEWDRVHPVXAGPVAPGQIREPRGSDIAGTTSNLQEQIAWMTHNPPIPVGEIYKRWIILGLNKIVRMYSPVSILDIRQGPKEPFRDYVDRFYKTLRAEQASQDVKNWMTETLLVQNANPDCXTILKALGPAATLEEMMTACQGVGGPGHKARVLAEAMSQVTTPPAIMMQKGNYRNQRKSVKCFNCGKEGHIAKNCRAPRKKGCWKCGKEGHQMKDCTERQANFLGKIWPSYKGRPGNFLQSRPEPTAPPEESFRFGEETTPPQKQERTDKELYPLASLRSLFGNDPSSQ

SEQ ID NO: 324 - protein, 500 aa, Human immunodeficiency virus
MGARASVLSGGELDRWEKIRLRPGGNKKYKLKHIVWASRELERFAVNPGLLETSEGCRQILGQLQPSLQTGSEELRSLYNTVAVLYCVHQKIEVKDTKEALDKIEEEQNKSKKKAQQAAADTENRNQVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPVSILDIRQGPKEPFRDYVDRFYKTLRAEQATQEVKNWMTETLLVQNANPDCKTILKALGPGATLEDMMTACQGVGGPGHKARVLAEAMSQVTNTATMMMQRGNFRSPRKTIKCFNCGKEGHIARNCRAPRKKGCWKCGQEGHQMKDCTERQANFLGKIWSSQKGRPGNFPQSRLEPTAPPEESFRFREETTTPSQKQEPIDKELYPLTSLKSLFGNDPSSQ

SEQ ID NO: 325 - protein, 500 aa, Human immunodeficiency virus
MGARASVLSGGELDKWEKIRLRPGGRKKYKLKHIVWASRELERFAVNPGLLETAEGCRQILGQLQPSLQTGSEELRSLFNTVATLYCVHQRIEIKDTKEALDKIEEEQNKSKKKAQQAAADTKNSSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGDIYKRWIILGLNKIVRMYSPTSILDIKQGPKEPFRDYVDRFYKVLRAEQASQDVKNWMTETLLVQNANPDCKTILEALGPAATLEEMMTACQGVGGPGHKARVLAEAMSQVSNSATVMMQRGNFRGQRKTVKCFNCGKEGHIARNCRAPRKKGCWRCGKEGHQMKDCTERQANFLGKIWPSHRERPGNFLQSRPEPTAPPQESFRFGEETTAPSQKQEPIDKELYPLASLRSLFGNDPSSQ

SEQ ID NO: 326 - protein, 495 aa, Human immunodeficiency virus
MGARASVLSGGKLDSWEKIRLRPGGKKKYKLKHIVWASRELERFAVNPGLLETSEGCRQILGQLQPSLQTGSEELRSLYNTVATLYCVHERIEVKDTKEALDKVEEEQNKSKKKAQQAAADTGNSSQVSQNYPIVQNIQGQMVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNSNPDCKTILKALGPGATLEEMMTACQGVGGPGHKARVLAEAMSQITNTSATIMMQGGNFRNQRKIKCFNCGKEGHISKNCRAPRKKGCWKCGKEGHQMKDCTERQANFLGKIWPSHKERPGNFLQSRPEPSAPPEESFRFGEETATPSQKQEPKELYPLASLKSLFGNDP

SEQ ID NO: 327 - protein, 500 aa, Human immunodeficiency virus
MGARASVLSGGELDRWEKIRLRPGGKKKYQLKHIVWASRELERFAVNPGLLETSEGCRQILGQLQPALQTGSEELKSLYNTVATLYCVHQKIDVKDTKEALDKIEEEQNKSKKKAQQAAADAGNNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSHVTNSATIMMQKGNFRNQRKIVKCFNCGKEGHIAKNCRAPRKRGCWKCGKEGHQMKDCTERQANFLGKIWPSHKGRPGNFLQSRPEPTAPPEESFRFGEETTTPSQKQEPIDQGMYPLASLRSLFGNDPSSQ

SEQ ID NO: 328 - protein, 505 aa, Human immunodeficiency virus
  variant (184)..(184): Xaa can be any naturally occurring amino acid
MGARASVLSGGELDRWEKIRLRPGGKKKYRLKHIVWASRELERFAVNPGLLETSEGCRQILGQLQPSLQTGSEELRSLFNTVATLYCVHQKIDVKDTKEALDKIQEEQNKCKKKVQQAAADTGNSSQVSQNYPIVQNLQGQMVHQAISPRTLNAWVKVVEEKAFSPEVIPMFSALSEGATPQDXNTMLNTVGGHQAAMQMLKETINEEAAEWDRVHPVQAGPIAPGQMRDPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNTATIMMQKGNFRNQRKIVKCFNCGKEGHIARNCRAPRKRGCWKCGKEGHQMKDCTERQANFLGKIWPSSKGRPGNFLQSRPEQSRLEPTAPPEESFRFGEETTTPPQKQEPIDKELYPLASLRSLFGNDPSSQ

SEQ ID NO: 329 - protein, 507 aa, Human immunodeficiency virus
MGARASVLSGGELDKWEKIRLKPGGKKTYKLKHIVWASRELEQFAVNPGLLETSKGCRQILGQLQPSLQTGSEELRSLYNTVATLYCVHQRIEVKDTKEALDKIEEEQNKSKQKAQQEKAQQAAAAADAGKNTQASQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTSSANIMMQRGNFRNQRRIVKCFNCGKEGHIAKNCRAPRKKGCWKCGKEGHQMKDCTERQANFLGKIWPSHKGRPGNFLQSRPEPTAPPEESFRFGEETTAPPQKQEPIDKELYPLASLRSLFGNDPSSQ

SEQ ID NO: 330 - protein, 498 aa, Human immunodeficiency virus
ARASVLSGGQLDKWEKIRLRPGGKKRYQLKHIVWASRELERFAVNPGLLETSEGCRQILGQLQPALQTGSEELKSLFNTVATLYCVHQRIDVRDTKEALDKIEEEQNKSKKKTQQAAADTENSSQVSQNYPIVQNLQGQMVHQAISPRTLNAWVKVVEEKSFSPEVIPMFAALSEGATPQDLNTMLNTVGGHQAAMQMLKETINEEAAEWDRVHPVHAGPIAPGQMREPRGSDIAGTTSTLQEQIGWMTNNPPIPVGDIYKKWIIIGLHKIVRMYSPTSILDIRQGPKEPFRDYVDRFYKTLRAEQASQEVKNWMTETLLVQNANPDCRTILKALGPAATLEEMMTACQGVGGPGHKARVLAEAMSQVTGSATIMMQKGNFRNQRKTVKCFNCGKVGHIAKNCRAPRKKGCWKCGKEGHQMKECDERQANFLGKIWPSHKGRPGNFLQSRPEPTAPPEESFRFGEETTTPSQKQEPIDKELYPLASLRSLFGNDPSSQ

SEQ ID NO: 331 - protein, 501 aa, Human immunodeficiency virus
MGARASVLSGGKLDSWERIRLRPGGKKKYRLKHIVWASRELERFAVNPGLLETAEGCKQILEQLQPALRTGSEELRSLYNTIATLYCVHQRIEVKDTKEALDKIEEEQNKSKKKAQQAAADTGNNSQVSQNYPIVQNMQGQMVHQAISPRTLNAWVKVVEEKAFSPEVIPMFSALSEGATPQDLNTMLNTVGGHQAAMQMLKETINEEAAEWDRLHPVQAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTGPATIMMQKGNFRNQRKIVKCFNCGKEGHIARNCRAPRKKGCWKCGKEGHQMKDCTERQANFLGKIWPSHKGRPGNFLQSRPEPSAPPAESFRFGEETTTPSQKQEPIDKDLYPPLASLKSLFGNDPSSQ

SEQ ID NO: 332 - protein, 503 aa, Human immunodeficiency virus
MGARASILSGGKLDRWEKIRLRPGGKKKYKLKHLVWASRELERFAVNPGLLETAEGCRQILGQLQPSLQTGSEELKSLFNAVAVLYCVHQGIDVKDTKEALERIEEEQEKSKKKAQQAAADPGKSSQVSQNYPIVQNIQGQMVHQSLSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIKQGPKEPFRDYVDRFYKTLRAEQATQEVKNWMTETLLVQNANPDCKTILKALGPGATLEEMMTACQGVGGPGHKARVLAEAMSQVTNSATIMMQRGNFKNQRKIVKCFNCGKEGHIAKNCRAPRKKGCWKCGKEGHQMKDCTERQANFLGKIWPSHKGRPGNFLQSRPEPTAPTAPPEESFRFREETTTPSQKQEPIDREMYPLTSLRSLFGNDPSSQ

SEQ ID NO: 333 - protein, 498 aa, Human immunodeficiency virus
RASILSGGKLDRWEKIRLRPGGKKKYKLKHIVWASRELERFAVNPGLLETSEGCRQILGQLQPSLPTGSEELKSLFNTVATLYCVHQNIDVKDTKEALEKIEEEQNKSKKKAQQAAADTGNSSQGSQNYPIVQNIQGQMVHQAISPRTLNAWVKVVEEKAFSPEVIPMFTALSEGATPQDLNTMLNTVGGHQAAMQMLKETINEEAAEWDRLHPVHAGPVAPGQMREPRGSDIAGTTSNLQEQIGWMTNNPPIPVGEIYKRWIILGLNKIVRMYSPSSILDIKQGPKEPFRDYVDRFYKTLRAEQASQEVKNWMTETLLVQNSNPDCKTILKALGPAATLEEMMTACQGVGGPGHKARVLAEAMSQVTNSATVMMQRGNFRNQRKTVKCFNCGKEGHIARNCKAPRRRGCWKCGKEGHQMKDCTERQANFLGKIWPSHKGRPGNFLQSRPEPTAPPEESFRFGEETTTPSPKQEPIDKDLYPPLASLKSLFGNDPLSQ

SEQ ID NO: 334 - protein, 505 aa, Human immunodeficiency virus
MGARASVLSGGKLDKWEKIRLRPGGKKKYKLKHIVWASRELERFAVNPGLLETTEGCRQILGQLQPSLQTGTEELRSLYNTIAVLYCVHQRIDIKDTKEALDKIEEEQDKSKQKAQQAAADTGNSNNQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQVGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSRVTNSNAIMMQRGNFKNQRKTVKCFNCGKEGHIARNCRAPRKKGCWKCGREGHQMKDCTERQANFLGKIWPSHKGRPGNFLQSRPEPTAPPAESFRFGEETTAPPQKQEPIDKEQGQELYPLASLRSLFGNDPSSQ

SEQ ID NO: 335 - protein, 500 aa, Human immunodeficiency virus
  variant (50)..(50): Xaa can be any naturally occurring amino acid
  variant (55)..(55): Xaa can be any naturally occurring amino acid
  variant (191)..(191): Xaa can be any naturally occurring amino acid
  variant (271)..(271): Xaa can be any naturally occurring amino acid
  variant (295)..(295): Xaa can be any naturally occurring amino acid
  variant (304)..(304): Xaa can be any naturally occurring amino acid
MGARASVLSGGELDRWEKIRLRPGGKKQYKLKHIVWASRELERFAINPGXLETSXGCRQILGQIQPSLQTGSEELRSLYNTIAVLYCVHQRIEVRDTKEALDKIEEEQNKSKKKEQQAAANTGNSSQVSQNYPIVQNLQGQMVHQPISPRTLNAWVKVVEEKAFSPEVIPMFSALSEGATPQDLNLMLNTXGGHQAAMQMLKETINEEAADWDRLHPVHAGPVAPGQMREPRGSDIAGTTSTLQEQIGWMTHNPPIPVGEIYKRWIILGLXKIVRMYSPTSILDIKQGPKEPFRXYVDRFYRTXRAEQASQEVKNWMTETLLVQNSNPDCKTILKALGPGATLEEMMTACQGVGGPGHKARVLAEAMSQVTNSATIMMQRGNFKNQRKMVKCFNCGKEGHIARNCRAPRKKGCWKCGKEGHQMKDCTERQANFLGKIWPSHKGRPGNFLQSRPEPTAPPEESFRFGEETATPPQKQEPKDKELYPLASLRSLFGNDPSSQ

SEQ ID NO: 336 - protein, 494 aa, Human immunodeficiency virus
MGARASVLSGGELDKWEKIRLRPGGKKKYKLKHIVWASRELERFAVNPGLLETAEGCKQILGQLQPALQTGSEELKSLFNTVATLYCVHQKIEVKDTKEALEKVEEEQNKSKKKAQQAAADTGNNSPVSQNYPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSSLQEQIAWMTNNPPIPVGEIYKRWIILGLNKIVRMYSPISILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRGQRKIVKCFNCGKEGHIAKNCRAPRKKGCWKCGKEGHQMKDCTERQANFLGKIWPSYKGRPGNFLQSRPEPTAPPEESFRFGEETTPSQKQERIPLTSLRSLFGNDPSSQ

SEQ ID NO: 337 - protein, 505 aa, Human immunodeficiency virus
MGARASVLSGGELDRWEKIRLRPGGKKKYKLKHIVWASRELERFAVNPSLLETSEGCRQILRQLQPSLQTGSEELKSLYNTVATLYCVHQRIEIKDTKEALDKIEEEQNKSKKKAQQTAADTGNSSQNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPAAPGQMREPRGSDIAGTTSTLQEQIGWMTNNPPIPVGEIYKRWIILGLNKIVRMYSPISILDIKQGPKEPFRDYVDRFYKTLRAEQATQEVKNWMTETLLVQNANPDCKTILKALGPAATLEEMMSACQGVGGPSHKARVLAEAMSQATNSAAAIMMQRGNFRNQRKTVKCFNCGKEGHIAKNCRAPRKKGCWKCGKEGHQMKDCTERQANFLGKIWPSHKGRPGNFLQSRPEPTAPPEYSFRFGEETTTPSQKQEPIDKETYPLASLKSLFGNDPSSQ

SEQ ID NO: 338 - protein, 506 aa, Human immunodeficiency virus
MGARASVLSGGQLDRWEKIRLRPGGKKRYKLKHIVWASRELERFAVNPGLLETSEGCRQILGQLQPTLQTGSEEIKSLYNTVAVLYCVHQRIEVKDTKEALDKIEEEQNKSKKKAQQAAADTGNSSQVSQNYPIVQNLQGQMVHQAISPRTLNAWVKVVEEKAFGPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQATNTATIMMMQRGNFRNQRKAVKCFNCGKEGHIARNCRAPRKKGCWKCGKEGHQMKECTERQANFLGKIWPSSKGRPGNFLQSRQGQNRLEPTAPPEESFRFGEETTTPPQKQEPIDKELYPLASLKSLFGNDPSSQ

SEQ ID NO: 339 - protein, 501 aa, Human immunodeficiency virus
  variant (313)..(313): Xaa can be any naturally occurring amino acid
MGARASVLSGGELDRWEKIRLRPGGKKKYKLKHIVWASRELERFAVNPGLLETAEGCRQILGQLQPALQTGSEELKSLFNTVATLYCVHQKIEIKDTKEALDKIEEEQNKSKKKAQQAAADAGNNSSQVSQNYPIVQNLQGQMVHQSLSPRTLNAWVKVIEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPVSILDIKQGPKEPFRDYVDRFYKTLRAEQATQXVKNWMTETLLVQNANPDCKTILKALGPAATLEEMMTACQGVGGPGHKARVLAEAMSQVTNSATIMMQRGNFRSQRKTVKCFNCGKEGHIAKNCRAPRKRGCWKCGKEGHQMKDCTERQANFLGKIWPSNKGRPGNFLQSRPEPTAPPEESFRFGEETTTPSQKQEPIDKELYPLASLRSLFGNDPSSQ

SEQ ID NO: 340 - protein, 498 aa, Human immunodeficiency virus
MGARASVLSGGKLDKWEKIRLRPGGKKKYKLKHLVWASRELERFAVNPGLLETSEGCRQILRQLQPSLQTGSEELKSLFNTVAVLYCVHQNIEIKDTKEALDEIEEEQNKSKKKAQQAAADTGNSSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQMTNSAAIMVQRGNFRDQRKIIKCFNCGKQGHIAKNCRAPRKKGCWKCGQEGHQMKDCTERQANFLGKIWPSHKGRPGNFLQSRPEPTAPPEESFRFGEETTPPSQKQEPIDKELYPLASLKSLFGNDP

SEQ ID NO: 341 - protein, 494 aa, Human immunodeficiency virus
  variant (17)..(17): Xaa can be any naturally occurring amino acid
  variant (28)..(28): Xaa can be any naturally occurring amino acid
MGARASVLSGGELDQWXRIRLRPGGKKXYKLKHIVWASRELERFAVNPGLLETSEGCRQILGQLQPSLQTGSEELRSLYNTVATLYCVHQKIEVKDTKEALEKIEEEQNKSKKKAQQEAADTGKSSQVSQNYPIVQNLQGQMVHQALSPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPISILDIRQGPKESFRDYVDRFYKTLRAEQASQEVKNWMTETLLVQNANPDCKTILKALGPAATLEEMMTACQGVGGPGHKARVLAEAMSQVTGTANIMMQRGNFRNQRKIVKCFNCGKEGHIAKNCRAPRKKGCWKCGKEGHQMKDCTERQANFLGKIWPSHKGRPGNFPQSRTEPTAPPEESFRFGEETTTPPQKEEPPLVSLRSLFGNDPSSQ

SEQ ID NO: 342 - protein, 500 aa, Human immunodeficiency virus
  variant (15)..(15): Xaa can be any naturally occurring amino acid
  variant (267)..(267): Xaa can be any naturally occurring amino acid
  variant (331)..(331): Xaa can be any naturally occurring amino acid
  variant (343)..(343): Xaa can be any naturally occurring amino acid
  variant (374)..(374): Xaa can be any naturally occurring amino acid
  variant (453)..(453): Xaa can be any naturally occurring amino acid
  variant (473)..(473): Xaa can be any naturally occurring amino acid
MGARASVLSGGKLDXWEKIRLRPGGKKQYKLKHIVWASRELERFAVNPGLLETSDGCRQILEQLQPALQTGSEELRSLFNTVAVLYCVHQRIDVKDTKEALDKIEEEQNKSKKKAQQAAAGTGNSSQVSQNYPIVQNLQGQMVHQALTPRTLNAWVKVIEEKAFSPEVIPMFSALSEGATPQDLNTMLNTVGGHQAAMQMLKETINEEAAEWDRLHPVHAGPIAPGQLREPRGSDIAGTTSTLQEQIGWMTNNPPIPVGEIYKRWIXLGLNKIVRMYSPVSILDIKQGPKEPFRDYVDRFYKTLRAEQATQEVKNWMTETLLVQNANPDCXTILKALGPGATXEEMMTACQGVGGPGHKARVLAEAMSQATAAXTIMMQKGNFRNQRKTIKCFNCGKEGHLARNCRAPRKRGCWKCGQEGHQMKDCTERQANFLGKLWPSQKGRPGNFLQNRXEPTAPPAESFRFGEETTTPXQKQEQIDKELNHSASLKSLFGNDPLLQ

SEQ ID NO: 343 - protein, 500 aa, Human immunodeficiency virus
  variant (384)..(384): Xaa can be any naturally occurring amino acid
MGARASILSGGQLDRWEKIRLRPGGKKQYKLKHLIWAGRELERFAVNPGLLETSEGCRQIIKQLQPSLQTGSEELRSLFNTVATLYCVHQRIDVKDTKEALDKIEEEQNKCKKKAEQAAADTGNSSQVSQNYPIVQNLQGQMVHQAITPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTSNPPIPVGEIYKRWIIMGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNSTTVMMQRGNFXNQRKTIKCFNCGKEGHLARNCRAPRKKGCWKCGKEGHQMKECTERQANFLGKIWPSHKGRPGNFLQSRPEPTAPPEESFRFGEETTTPSQKQETIDKELYPLASLKSLFGNDPSYQ

SEQ ID NO: 344 - protein, 501 aa, Human immunodeficiency virus
MGARASVLSGGELDKWEKIRLRPGGKKKYRLKHIVWASRELERFALNPSLLETSGGCRQILGQLQPSLQTGSEELKSLFNTIAVLYCVHQRIDVKDTKEALDKIEEEQNKTKKKAQQAAADTGNSSQVSQNYPIVQNLQGQMVHQPISPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIAWMTNNPPIPVGDIYKRWIILGLNKIVRMYSPSSILDIKQGPKEPFRDYVDRFYKTLRAEQASQDVKNWMTETLLVQNSNPDCKTILKALGPAATLEEMMTACQGVGGPSHKARVLAEAMSQMTSPANIMMQRGNFKNQRKIVKCFNCGKEGHIARNCRAPRKKGCWKCGQEGHQMKDCTERQANFLGKIWPSHKGRPGNFLQSRPEPTAPPAESLMFGEETTTPPQKQEPRDKELYPPLASLRSLFGNDPSSQ

SEQ ID NO: 345 - protein, 501 aa, Human immunodeficiency virus
MGARASVLSGGELDRWEKIRLRPGGKKRYKLKHIVWASRELERFALNPGLLETSEGCRQIIGQLQPSLQTGSEELKSLYNTVATLYCVHQKIDVKDTKEALDKIEEEQNKSKKKAQQAVAGTGNNSQVSQNYPIVQNMQGQMVHQAISPRTLNAWVKVVEEKAFSPEVIPMFTALSEGATPSDLNTMLNTVGGHQAAMQMLKETINEEAAEWDRLHPVHAGPIAPGQMREPRGSDIAGTTSTLQEQIAWMTSNPPIPVGDIYKRWIILGLNKIVRMYSPTSILDIKQGPKEPFRDYVDRFYKTLRAEQASQDVKNWMTETLLVQNANPDCKTILKALGPGATLEEMMTACQGVGGPSHKARVLAEAMSQATNSAAIMMQRGNFRNQRKTVKCFNCGREGHIAKNCRAPRKKGCWKCGKEGHQMKDCTTERQANFLGKIWPSHKGRPGNFLQSRPEPTAPPAESFGFGEEKTTPSQKPETTDKELYPLASLKSLFGNDPSSQ

SEQ ID NO: 346 - protein, 493 aa, Human immunodeficiency virus
ASVLSGGKLDTWEKIRLRPGGKKKYKLKHIVWASRELERFALNPGLLETAEGCRQLLGQLQPSLQTGSEELKSLFNTIATLYCVHQRIEVRDTKEALDKIEEEQNKSKKKAQQAAAAADTGNSSQVSQNYPIVQNLQGQMVHQAISPRTLNAWVKVIEEKAFSPEVIPMFAALSEGATPQDLNTMLNTVGGHQAAMQMLKETINEEAAEWDRIHPAQAGPIAPGQIRDPRGSDIAGTTSTLQEQITWMTNNPPIPVGEIYKKWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSGAIMMQKGNFRNQVVRCFNCGKVGHIAKNCRAPRKKGCWKCGKEGHQMKDCDQRQANFLGKIWPSHKGRPGNFLQSRPEPTAPPAESFRFGEETTTPSQKQEPQEYPLASLRSLFGNDPSSQ

SEQ ID NO: 347 - protein, 502 aa, Human immunodeficiency virus
MGARASVLSGGKLDRWEKIRLRPGGKKKYKLKHIVWASRELERFAVNPGLLETSEGCRQILGQLQPSLQTGSEELKSLYNTIAVLYCVHQNIDVKDTKEALDMIEEEQNKSKKKAQQAAAAADTGNSGNVSQNYPIVQNLQGQMVHQPISPRTLNAWVKVVKEKAFSPEVIPMFAALSEGATPQDLNTMLNTVGGHQAAMQMLKETINEEAAEWDRLHPVHAGPIAPGQMREPRGSDIAGTTSTLQEQIAWMTNNPAIPVGEIYKKWIIMGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNSATVMMQRGNPRNQRKTIKCFNCGKEGHLARNCRAPRKRGCWKCGKEGHQMKDCTERQANFLGKIWPSHKGRPGNFLQSRPEPSAPPEESFRFGEETTAPPQKQEPRDKELYPVTSLRSLFGNDPSSQ

SEQ ID NO: 348 - protein, 499 aa, Human immunodeficiency virus
MGARASVLSGGELDRWEKIRLRPGGKKKYKLKHIVWASRELERFAVNPSLLETSEGCRQILGQLQPSLQTGSEELKSLFNTVATLYCVHQRIEVKDTKEALEKIEEEQNKSKKKAQQAAADTGNSGQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGDIYKRWIIMGLNKIVRMYSPTSILDVKQGPKEPFRDYVDRFYKILRAEQASQEVKHWMTETLLVQNANPDCKTILKALGPAATLEEMMTACQGVGGPGHKARVLAEAMSQVTNSTIMMQKGNFRNQRKTVKCFNCGKEGHIAKNCRAPRKKGCWKCGKEGHQMKDCSERQANFLGKIWPSHKGRPGNFLQSRPEPTAPPEESFRFGEETTTPSQKQEPIDKEQYPLASLRSLFGNDPSSQ

SEQ ID NO: 349 - protein, 504 aa, Human immunodeficiency virus
MGARASVLSGGELDKWEKIRLRPGGKKQYKLKHIVWASRELERFAVNPGLLETSEGCRQILRQLQPSLQTGSEELKSLFNTVAVLYCVHQRIEVRDTKEALDKIEEEQNKSKKQAQQAAAGTGNNTGNNSQVSQNYPIVQNLQGQMVHQAISPRTLNAWVKVVEEKAFSPEVIPMFSALSEGATPQDLNTMLNTVGGHQAAMQMLKETINEEAAEWDRLHPPQAGPIAPGQIREPRGSDIAGTTSNLQEQITWMTNNPPIPVGEIYKRWIIMGLNKIVRMYSPTSILDIRQGPKEPFRDYVDRFYKTLRAEQASQEVKNWMTKTLLVQNANPDCKTILKALGPAATLEEMMTACQGVGGPGHKARVLAEAMSQVTNSATVMMQRGNFKGQRKIVKCFNCGKEGHIARNCRAPRKKGCWKCGQEGHQMKDCTGRQANFLGKIWPSHKGRPGNFLQSRPEPTAPPAESFRFGEETPTPSQKQETIDKELYPLASLKSLFGNDPSSQ

SEQ ID NO: 350 - protein, 500 aa, Human immunodeficiency virus
MGARASILSGGELDRWEKIRLRPGGKKKYKLKHIVWASRELERFAVNPGLLETSEGCRQILEQLQPSLQTGSEELKSLFNTIATLYCVHQRIEIKDTKEALEKIEEEQNKSKKKAQQAAADTGNSKQVSQNYPIVQNLQGQMVHQAISPRTLNAWVKVVEEKAFSPEVIPMFTALSEGATPQDLNTMLNTVGGHQAAMQMLKETINEEAAEWDRVHPVHAGPIAPGQMREPRGSDIAGTTSTLQEQIAWMTNNPPVPVGEIYKRWIILGLNKIVRMYSPTSILDIRQGPKEPFRDYVDRFYKTLRAEQASQDVKNWMTETLLVQNSNPDCKTILKALGPAATLEEMMTACQGVGGPGHKARVLAEAMSQATSSNTIMMQRGNFRNQRKTIKCFNCGKEGHIAKNCRAPRKKGCWKCGKEGHQMKDCTERQANFLGKIWPSHKGRPGNFLQSRPEPTAPPEESFRFGEETTTPPQKQEPIDKELYPLASLKSLFGNDPSSQ

SEQ ID NO: 351 - protein, 499 aa, Human immunodeficiency virus
MGARASVLSGGELDRWEKIRLRPGGKKQYKLKHIVWASRELERFALNPGLLETSEGCRQILGQLQPAIQTGSEELRSLFNTVATLYCVHQRIDIKDTKEALDKIEEEQNKSKKKVQQEAADTGSKSQVSQNYPIVQNIQGQMVHQPISPRTLNAWVKVVEEKAFSPEVIPMFSALAEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQMNSATIMMQKSNFRNQRKIVKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 352 - protein, 500 aa, Human immunodeficiency virus
MGARASVLSGGELDRWEKIRLRPGGKKMYKLKHIVWASRELERFALNPGLLETSEGCKQILTQLQPSLQTGSEELKSLFNTVATLYCVHQRIEVRDTKEALDKIEEEQNKSKKKAQQAAADTGSSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPSSILDIKQGPKEPFRDYVDRFYKTLRAEQASQEVKNWMTETLLVQNANPDCKTILKALGPAATLEEMMTACQGVGGPGHKARVLAEAMSQLTNSANIMMQRGNMRNQRKTVKCFNCGKEGHIARNCRAPRKKGCWKCGKEGHQMKDCTERQANFLGKIWPSHKGRPGNFLQSRPEPSAPPEESFRFGEETTTPPQKQEPIDKEVFPLASLKSLFGNDPSSQ

SEQ ID NO: 353 - protein, 503 aa, Human immunodeficiency virus
MGARASVLSGGKLDQWERIRLRPGGNKRYKLKHIVWASRELERFAVNPGLLETAEGCRQILGQLQPSLQTGSEELKSLYNTIATLYCVHQRIDVKDTKEALDKIEEEQNKSKKKAQQAAAATGNNSQSSQVSQNYPIVQNLQGQMVHQPLSPRTLNAWVKVVEEKAFSPEVIPMFTALSEGATPQDLNTMLNTVGGHQAAMQMLKETINEEAAEWDRLHPAQAGPIAPGQIREPRGSDIAGTTSTLQEQITWMTNNPPIPVGEIYKRWIILGLNKIVRMYSPTSILDIRQGPKEPFRDYVDRFYKTLRAEQASQEVKNWMTETLLVQNANPDCKTILKALGPAASLEEMMTACQGVGGPGHKARVLAEAMSQVTNSNTIMMQRGNFRNQRKIVKCFNCGKEGHIARNCRAPRKKGCWKCGKEGHQMKECTERQANFLGKIWPSHKGRPGNFLQSRPEPTAPPEESFRFGEEAPAPSQKQETIDKELYPSASLRSLFGNDPSSQ

SEQ ID NO: 354 - protein, 500 aa, Human immunodeficiency virus
MGARASVLSGGELDRWEKIRLRPGGKKRYKLKHIVWASRELERFAVNPGLLETSGGCRQILEQLQPALQTGSEELKSLYNTVATLYCVHQRIEVKDAKEALEKIEEEQNKSKKKAQQAAADAGNNRQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWVTNNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQVTNSASIMMQRGNFRNQKKIVKCFNCGKDGHIAKNCRAPRKRGCWKCGQEGHQMKDCTERQANFLGKIWPSYKGRPGNFLQSRPEPTAPPEESFRFGEETTTPSQKQEPIDKELYPLASLKSLFGNDPSSQ

SEQ ID NO: 355 - protein, 499 aa, Human immunodeficiency virus
MGARASVLSGGQLDRWEKIRLRPGGKKKYKLKHIVWASRELERFAVNPGLLETSDGCRQILEQLQPALKTGSEELRSLYNTVATLYCVHQKIEVKDTKEALEKIEEEQNKSKKKAQQAAADTGNSSQVSHNYPIVQNIQGQMVHQALSPRTLNAWVKVVEEKAFSPEVIPMFSALSEGATPQDLNTMLNTVGGHQAAMQMLKETINEEAAEWDRLHPAHAGPVAPGQMREPRGSDIAGTTSTLQEQIGWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPSHKARILAEAMSQVTNLPTIMMQKGNFRGQRKIKCFNCGKEGHLAKNCRAPRKRGCWKCGKEGHQMKDCTERQANFLGKIWPSHKGRPGNFLQSRPEPSAPPEESFRFGEGTTTPSQKQEPIDKETYPLTSLRSLFGNDPSSQ

SEQ ID NO: 356 - protein, 463 aa, Human immunodeficiency virus
MGARASVLSGGQLDAWEKIRLRPGGKKKYRLKHIVWASRELERFAVNPGLLETAAGCRQILNQLQPSLQTGSEELKSLFNTVAVLYCVHQRIDVKDTKEALDKIEEEQNKSKKKAQQAVADAGNNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKSWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQATNSATIMMQRGNFRNQRKTVKCFNCGKEGHIARNCRAPRKKGCWKCGKEGHQIKDCTERQANFLGKIWPSSKGRPGNFLQSRPEPTAPPEESF

SEQ ID NO: 357 - protein, 462 aa, Human immunodeficiency virus
MGARASVLSGGELDKWEKIRLRPGGKKKYQLKHIVWASRELERFAVNPSLLETSEGCRQILGQLQPALQTGSEELKSLHNTVAVLYCVHQRIDVKDTKEALEKIEEEQNKSKKKAQQAAANTGNSNQISQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNSTTIMMQRGNDRNQRKIKCFNCGKEGHLARNCRAPRKRGCWKCGQEGHQMKECPGRQANFLGKIWPSHKGRPGNFLQNRPEPTAPPEESF

SEQ ID NO: 358 - protein, 500 aa, Human immunodeficiency virus
MGARASVLSGGDLDRWEKIRLRPGGKKKYMLKHIVWASRELERFAVNPGLLETSEGCRQVLEQLQPSLQTGSEELRSLYNTIATLYGVHQKIEVKDTKEALDKIEEEQNKSKKKAQQAAADTGHSSQVSQNYPIVQNLQGQMVHQAISPRTLNAWVKVIEEKAFSPEVIPMFSALSEGATPQDLNTMLNTVGGHQAAMQMLKETINEEAAEWDRVHPVQAGLIAPGQMREPRGSDIAGTTSTLQEQIGWMTSNPPIPVGEIYKRWIILGLNKIVRMYSPISILDIRQGPKEPFRDYVDRFYKTLRAEQASQEVKNWMTETLLVQNANPDCKTILKALGPGATLEEMMTACQGVGGPGHKARVLAEAMSQVTNSAAIMMQRGNFKNQRKMVKCFNCGKEGHVARNCRAPRKKGCWKCGKEGHQMKDCIESQANFLGKIWPSHKGRPGNFLQSRPEPTAPPEESLRSGIETTTPSQKQEPIDKEVYPLTSLRSLFGNDPSSQ

SEQ ID NO: 359 - protein, 500 aa, Human immunodeficiency virus
MGARASVLSGGELDRWEKIRLRPEGKKRYKLKHIVWASRELERFAVNPGLLETSEGCRQILIQLQPSLQTGSEELRSLYYTVATLYCVHQRIEVKDTKEALEKIEEEQNKSKKKAQQAAAGTGNSSQVSQNYPIVRNIQGQMVHQPLSPRTLNAWVKVVEEKAFSPEVIPMFSALSEGATPQDLNTMLNTVGGHQAAMQMLKETINEEAADWDRLHPVHAGPVAPGQMREPRGSDIAGTTSTLQEQIGWMSNNPPIPVGEIYKRWIILGLNKIVRMYSPASILDIRQGPKEPFRDYVDRVYKTLRAEQASQEVKNWMTETLLVQNANPDCKTILKALGPGATLEEMMTACQGVGGPGHKARVLAEAMSQVTNSANIMMQRGNFRNQRKVVKCFNCGKEGHIARNCRAPRKKGCWKCGKEGHQMKDCTERQANFLGKIWPSHKGRPGNFLQSRPEPSAPPEESFRFGEEATTSPQKQELIDKELYPLTSLRSLFGNDPLSQ

SEQ ID NO: 360 - protein, 499 aa, Human immunodeficiency virus
MGARASVLSGGELDKWEKIRLRPGGKKQYKLKHIVWASRELERFAVNPGLLETAEGCKQIIGQLQPSLQTGSEELRSLYNTVAVLYCVHQKIDVKDTKEALEKIEEEQNKSKKKAQQAAADTGNNSKVSQNYPIVQNLQGQMVHQTISPRTLNAWVKVIEEKAFSPEVIPMFSALSEGATPQDLNTMLNTVGGHQAAMQMLKETINEEAAEWDRLHPVHAGPVAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNSATIMMQRNNFRDQRRTVKCFNCGRVGHIAKNCRAPRKRGCWKCGKEGHQMKDCTERQANFLGKIWPSHKGRPGNFLQNRPEPTAPPEESFRFGEETTPPQKQEQIDKEMYPLASLKSLFGNDPLSQ

SEQ ID NO: 361 - protein, 503 aa, Human immunodeficiency virus
  variant (40)..(40): Xaa can be any naturally occurring amino acid
  variant (96)..(96): Xaa can be any naturally occurring amino acid
  variant (114)..(114): Xaa can be any naturally occurring amino acid
  variant (124)..(124): Xaa can be any naturally occurring amino acid
  variant (136)..(136): Xaa can be any naturally occurring amino acid
  variant (198)..(198): Xaa can be any naturally occurring amino acid
  variant (221)..(221): Xaa can be any naturally occurring amino acid
  variant (240)..(240): Xaa can be any naturally occurring amino acid
  variant (335)..(335): Xaa can be any naturally occurring amino acid
  variant (338)..(338): Xaa can be any naturally occurring amino acid
  variant (365)..(365): Xaa can be any naturally occurring amino acid
  variant (377)..(377): Xaa can be any naturally occurring amino acid
  variant (419)..(419): Xaa can be any naturally occurring amino acid
  variant (437)..(437): Xaa can be any naturally occurring amino acid
  variant (453)..(453): Xaa can be any naturally occurring amino acid
  variant (468)..(468): Xaa can be any naturally occurring amino acid
MGARASVLSGGELDRWEKIRLRPGGKKKYRLKHIVWASRXLERFALNPGLLETSGGCRQILGQLQPSLQTGSEEIKSLYNTVATLYCVHQKIEIRXTKEALDKIEEEQNKSKKXAQQAAADAEXSSRQVSQNYPIXQNLQGQMVHQPISPRTLNAWVKVVEEKAFSPEVIPMFTALSEGATPQDLNTMLNIVGGHQAXMQMLKETINEEAAEWDRMHPVHXGPIAPGQMREPRGSDIAGXTSTLQEQIGWMTSNPPIPVGEIYKRWIILGLNKTVRMYSPISILDIRQGPKEPFRDYVDRFYKTLRAEQASQEVKNWMTETLLVQNANPDCRTIXKAXGPAATLEEMMTACQGVGGPGHKARVLXEAMSQVTNSTAXMMQKGNFRNQRKPVKCFNCGREGHIAKNCKAPRKKGCWKCGXEGHQMKDCTERQANFLGXIWSSHKGRPGNFLQSXPEPTAPPEESFRFGXGTITPSQKQEPIEKDKDLYPLASLKSLFGNDPLSQ

SEQ ID NO: 362 - protein, 502 aa, Human immunodeficiency virus
  variant (9)..(9): Xaa can be any naturally occurring amino acid
  variant (11)..(11): Xaa can be any naturally occurring amino acid
  variant (17)..(17): Xaa can be any naturally occurring amino acid
  variant (46)..(46): Xaa can be any naturally occurring amino acid
  variant (100)..(100): Xaa can be any naturally occurring amino acid
  variant (127)..(127): Xaa can be any naturally occurring amino acid
  variant (159)..(159): Xaa can be any naturally occurring amino acid
  variant (181)..(181): Xaa can be any naturally occurring amino acid
  variant (263)..(263): Xaa can be any naturally occurring amino acid
  variant (444)..(444): Xaa can be any naturally occurring amino acid
  variant (449)..(449): Xaa can be any naturally occurring amino acid
  variant (455)..(455): Xaa can be any naturally occurring amino acid
  variant (459)..(459): Xaa can be any naturally occurring amino acid
  variant (462)..(462): Xaa can be any naturally occurring amino acid
MGARASVLXGXDLDRWXKIRLRPGGKKKYRLKHIVWASRELERFAXNPGLLETSGGCRQILQQLQPSLQTGSEELKSLYNTVATLYCVHQRIDVKDTKEXLDKIEEEQSKSKKKVQQAAADAGTSSXSQVSHNYPIVQNLQGQMVHQPISPRTLNAWVXVVEEKAFSPEVIPMFSALSEGXTPQDLNTMLNTVGGHQAAMQMLKETINEEAAEWDRLHPVQAGPVAPGQMRDPRGSDIAGTTSTLQEQIGWMTHNPPIPVGEXYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVNNPTNIMMQRGNFKNQRKPVKCFNCGKEGHIAKNCRAPRRKGCWKCGREGHQMKDCTERQANFLGKIWPSHXGRPGXFLQSRXEPSXPPXESFRFGEEKPTPPQKQEPIDKDLYPLASLRSLFGNDPSSQ

SEQ ID NO: 363 - protein, 499 aa, Human immunodeficiency virus
MGARASVLSGGKLDMWEKIRLRPGGKKQYKLKHIVWASRELERFAINPGLLETSEGCKQILGQLQSSLQTGSEELKSLYNTVAVLYCVHQRIEIKDTKEALDKIEEEQNKSKRKTQQAAADTGNSSQVSQNYPIVQNLQGQMVHQALSPRTLNAWVKVIEEKAFSPEVIPMFTALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIKQGPKEPFRDYVDRFYKTLRAEQATQEVKNWMTETLLVQNANPDCKTILKALGPAATLEEMMTACQGVGGPGHKARVLAEAMSQVTNPTIMMQRGNFRNQRRIIKCFNCGKDGHIAKNCRAPRKKGCWKCGQEGHQMKDCTERQANFLGKLWPSHKGRPGNFLQSRPEPTAPPEESFRFGEEATAPPQKQEPIDQERYPLASLRSLFGNDPLSQ

SEQ ID NO: 364 - protein, 499 aa, Human immunodeficiency virus
  variant (28)..(28): Xaa can be any naturally occurring amino acid
  variant (35)..(35): Xaa can be any naturally occurring amino acid
  variant (71)..(71): Xaa can be any naturally occurring amino acid
  variant (88)..(88): Xaa can be any naturally occurring amino acid
  variant (160)..(160): Xaa can be any naturally occurring amino acid
  variant (425)..(425): Xaa can be any naturally occurring amino acid
  variant (470)..(470): Xaa can be any naturally occurring amino acid
  variant (472)..(472): Xaa can be any naturally occurring amino acid
MGARASVLSAGELDRWERIRLRPGGKKXYRLKHIXWASRELERFAVNPGLLETSEGCRQILGQLQPSLQTXSEELRSLHNTVAVLYCXHQNIEVKDTKEALEKIEEEQKKSQKKAQQAAADTKNNPVSQNYPIVQNMQGQMVHQAISPRTLNAWVKVVEXKAFSPEVIPMFSALSEGATPQDLNTMLNTVGGHQAAMQMLKETINEEAAEWDRLHPVHAGPIAPGQMREPRGSDIAGTTSTLQEQINWMTNNPPIPVGEIYKRWIILGLNKIVRMYSPASILDIKQGPKEPFRDYVDRFYKTLRAEQATQEVKNWMTETLLVQNANPDCKTILKALGPAATLEEMMTACQGVGGPSHKARVLAEAMSQVTNSNTIMMQRGNFRNQRKMVKCFNCGKEGHIARNCRAPRKKGCWKCGKEGHQMKDXTERQANFLGKIWPSHKGRPGNFLQNRPEPSAPPAESFRFGEETTXPXQKQEPIDKELYPSASLRSLFGNDPSSQ

SEQ ID NO: 365 - protein, 501 aa, Human immunodeficiency virus
  variant (127)..(127): Xaa can be any naturally occurring amino acid
  variant (487)..(487): Xaa can be any naturally occurring amino acid
MGARASVLSGGKLDHWEKIRLRPGGKKQYRLKHLVWASRELERFAINPGLLETSEGCRQILGHLQPSLQTGSEELRSLYNAVATLYCVHQRIDVKDTKEALDKIEEEQNESKKRTQPAAAGAGNNSXVSQNYPIVQNLQGQMVHQSLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMSLATNNQATIMMQKGNFKNQRKTIKCFNCGKEGHIARNCRAPRKKGCWKCGKEGHQIKDCTERQANFLGKVWPSRNGRPGNFLQNRPEPSAPPAEGIKFGEETTTPPQKQGPVEEGLYPXASLRSLFGNDPSSQ

SEQ ID NO: 366 - protein, 498 aa, Human immunodeficiency virus
MGARASVISGGELDKWERIRLRQGGSKKYRLKHIVWASRELERYAINPGLLETSEGCRQILGQLQPAIQTGSEELRSLYNTIATLYCVHQKIDVRDTKEALEKIEEEQNKSKKKAQQAAADTKNSSQVSQNYPIVQNLQGQMVHQAISPRTLNAWVKVVEEKAFSPEVIPMFSALSEGATPQDLNTMLNTVGGHQAAMQMLKDTINEEAAEWDRVHPVHAGPIAPGQIREPRGSDIAGTTSTLQEQIAWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNSTAIMMQKGNFRNQRKAVKRFNCGKEGHIARNCRAPRKKGCWKCGKEGHQMKDCTERQANFLGKIWPSHKGRPGNFLQSRPEPTAPPAESFRFGEETTTQKQGPKDKELYPLDSLKSLFGSDPSLQ

SEQ ID NO: 367 - protein, 500 aa, Human immunodeficiency virus
  variant (182)..(182): Xaa can be any naturally occurring amino acid
  variant (202)..(202): Xaa can be any naturally occurring amino acid
  variant (213)..(213): Xaa can be any naturally occurring amino acid
  variant (275)..(275): Xaa can be any naturally occurring amino acid
  variant (304)..(304): Xaa can be any naturally occurring amino acid
  variant (349)..(349): Xaa can be any naturally occurring amino acid
  variant (353)..(353): Xaa can be any naturally occurring amino acid
  variant (389)..(389): Xaa can be any naturally occurring amino acid
MGARASVLSGGKLDQWEKIRLRPGGKKRYELKHIVWASRELERFAVNPGLLETSEGCRQILGQLHPSLPTGSEELKSLYNTVATLYCVHQRIDVKDTKEALDKIEEEQNKSKKKAQQAAADTGNSSQVSQNYPIVQNMQGQMVHQAISPRTLNAWVKVIEEKAFSPEVIPMFTALSEGATPXDLNTMLNTVGGHQAAMQMLXETINEEAAEWXRLHPVHAGPIAPGQMREPRGSDIAGTTSTLQEQIGWMTHNPPIPVGDIYKRWIIMGLNKIVXMYSPTSILDIKQGPKEPFRDYVDRFYKTXRAEQASQEVKNWMTETLLVQNANPDCKTILKALGPAATLEEMMTXCQGXGGPGHKARVLAEAMSQVTNSATIMMQRGNFRNQRKXVKCFNCGKEGHIAKNCRAPRKKGCWKCGKEGHQMKDCIERQANFLGKIWPSHKGRPGNFLQSRPEPTAPPEESFRFVEETTTPSQKPETIDKEVYPLASLKSLFGNDPSSQ

SEQ ID NO: 368 - protein, 506 aa, Human immunodeficiency virus
  variant (225)..(225): Xaa can be any naturally occurring amino acid
  variant (330)..(330): Xaa can be any naturally occurring amino acid
  variant (360)..(360): Xaa can be any naturally occurring amino acid
  variant (441)..(441): Xaa can be any naturally occurring amino acid
  variant (466)..(466): Xaa can be any naturally occurring amino acid
MGARASVLSGGKLDHWEKIRLRPGGKKKYKLKHIVWASRELERFAINPGLLETSEGCRQIIEQLQSALQTGSEELKSLYNTIAVLYCVHQRIEIKDTKEALDKIEEEQTKSKKKAQQAKAADAGNSSTVSVSQNYPIVQNAQGQMVHQPISPRTLNAWVKVVEEKAFSPEVIPMFSALSEGATPQDLNTMLNTVGGHQAAMQMLKETINEEAAEWDRVHPAQAGXVAPGQIRDPRGSDIAGTTSTLQEQIAWMTHNPPIPVGEIYKRWIILGLNKIVRMYSPTSILDIKQGPKEPFRDYVDRFYKTLRAEQASQDVKNWMTETLLVQNAXPDCKTILKALGPAATLEEMMTACQGVGGPXHKARVLAEAMSQVTNSTAAAMMQRGNFRDQRKIVKCFNCGKVGHIAKNCRGPRKKGCWKCGKEGHQMKDCNERQGQANFLXKIWPSHKGRPGNFLQSRPEPTAPPXESFRFGEETTTPSQKQETIDKEMYPLASLKSLFGNDPLSQ

SEQ ID NO: 369 - protein, 500 aa, Human immunodeficiency virus
  variant (15)..(15): Xaa can be any naturally occurring amino acid
  variant (23)..(23): Xaa can be any naturally occurring amino acid
  variant (48)..(48): Xaa can be any naturally occurring amino acid
  variant (61)..(61): Xaa can be any naturally occurring amino acid
  variant (164)..(164): Xaa can be any naturally occurring amino acid
  variant (182)..(182): Xaa can be any naturally occurring amino acid
  variant (223)..(223): Xaa can be any naturally occurring amino acid
  variant (243)..(243): Xaa can be any naturally occurring amino acid
  variant (274)..(274): Xaa can be any naturally occurring amino acid
  variant (370)..(370): Xaa can be any naturally occurring amino acid
  variant (372)..(372): Xaa can be any naturally occurring amino acid
  variant (409)..(409): Xaa can be any naturally occurring amino acid
  variant (460)..(460): Xaa can be any naturally occurring amino acid
  variant (464)..(464): Xaa can be any naturally occurring amino acid
MGARASVLSGGKLDXWEKIRLRXGGKKRYKLKHLVWASRELERFAVNXGLLESSGGCKQIXGQLQPALQTGSEELKSLYNTIVVLYYVHQRIEIRDTKEALDKLEEEQNKCKKKAQQAAADTGNSSQVSQNYPVVQNLQGQMVHQALSPRTLNAWVKVVEEKAXSPEVIPMFSALSEGATPXDLNTMLNTVGGHQAAMQMLKETINEEAAEWDRLHPVHAGPXAPGQMREPRGSDIAGTTSTXQEQIGWMTNNPPIPVGEIYKRWIILGLNKIXRMYSPTSILDIRQGPKEPFRDYVDRFYKTLRAEQASQEVKNWMTETLLVQNANPDCKTILKALGPAATLEEMMTACQGVGGPGHKARVLAEAMSQXTXTPTIMMQKGNFRGQRKIIKCFNCGKEGHLARNCRAPXKRGCWKCGKEGHQMKDCTERQANFLGKAWSSHKGRPGNFLQSRPEPTAPPXESFXFGEETTTPPQRQEPIDKEVYPLASLRSLFGNDPSSQ

SEQ ID NO: 370 - protein, 502 aa, Human immunodeficiency virus
  variant (108)..(108): Xaa can be any naturally occurring amino acid
  variant (176)..(176): Xaa can be any naturally occurring amino acid
  variant (228)..(228): Xaa can be any naturally occurring amino acid
  variant (430)..(430): Xaa can be any naturally occurring amino acid
  variant (467)..(467): Xaa can be any naturally occurring amino acid
  variant (471)..(471): Xaa can be any naturally occurring amino acid
  variant (475)..(475): Xaa can be any naturally occurring amino acid
MGARASILSGGDLDRWEKIRLRPGGKKRYQLKHIIWASRELERFAVNPGLLETSEGCRQILRQLHPSLETGSEELKSLYNTVAVLLCVHQRIEVKDTKEALDKIEEEXNKSKKKAQQAAAADTGNSNPGSGGSQNFPIVQNLQGQMVHQALSPRTLNAWVKVVEEKAFSPEVIPMXTALSEGATPQDLNTMLNTVGGHQAAMQMLKETINEEAAEWDRVHPVHAGPVXPGQMREPRGSDIAGTTSTLQEQIGWMTNNPPIPVGEIYKRWIILGLNKIVRMYSPTSILDIKQGPKEPFRDYVDRFYKTLRAEQASQDVKNWMTETLLVQNANPDCKTILKALGPGATLEEMMTACQGVGGPGHKARVLAEAMSQVTGANTIMMQRGNFKNQRKAVKCFNCGKEGHIARNCRAPRKKGCWKCGREGHQMKDXTERQANFLGKIWPSHKGRPGNFLQNRTEPTAPPEESXRFGXEKTXPPQKQEPKELYPLTSLRSLFGNDPSPQ

SEQ ID NO: 371 - protein, 500 aa, Human immunodeficiency virus
  variant (249)..(249): Xaa can be any naturally occurring amino acid
  variant (435)..(435): Xaa can be any naturally occurring amino acid
MGARASILSGGELDRWEKIRLRPGGKKKYQLKHIVWASRELERFSVNPGLLETSEGCRQILGQLQPALKTGSEEFRSLYNAIAVLYCVHQRIDIKDTKEALDKIEEEQNESKKKAQQAAADTGNNKQVSQNYPIVQNMQGQMVHQAISPRTLNAWVKVIEEKAFSPEVIPMFSALSEGATPGDLNTMLNTVGGHQAAMQMLKETINEEAAEWDRLHPVQAGPVAPGQIREPRGSDIAGTTSTLQEQITXMTSNPPIPVGEIYKRWIILGLNKIVRMYSPTSILDIKQGPKEPFRDYVDRFYKTLRAEQATQEVKNWMTETLLVQNANPDCKTILKALGPGASLEEMMTACQGVGGPAHKARVLAEAMSQVTNSTAIMMQRGNFKNQRKTVKCFNCGKEGHIAKNCRAPRKRGCWKCGKEGHQMKDCTERQANFLXKIWPSHKGRPGNFLQSRPEPSAPPEESFRFGEETTTPPQKQEPTDKEHYPLASLRSLFGNDPLSQ

SEQ ID NO: 372 - protein, 503 aa, Human immunodeficiency virus
MGARASVLSGGELDRWEKIRLRPGGKKKYRLKHLVWASRELERFAVNPGLLETSEGCRQILGQLQPSLQTGSEELKSLYNTIAVLYCVHQRIEVKDTKEALDKIEEEQNKSKKKAQQAAADTGNSSQNSQNYPIVQNIQGQMVHQPISPRTLNAWVKVVEEKAFSPEVIPMFSALSEGATPQDLNTMLNTVGGHQAAMQMLKETINEEAAEWDRLHPVHAGPVAPGQMREPRGSDIAGVTSNLQEQIAWMTSNPPIPVGDIYKKWIIMGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVPGSANIMMQRGNYRNQKKSVKCFNCGKEGHVARNCRAPRKKGCWKCGKEGHQMKDCTERQANFLGKIWPSYKGRPGNFLQNRPEPTAPPEPTAPPEESFRFGEETTTPSQKQGMTDKEMYPLTSLKSLFGNDP

SEQ ID NO: 373 - protein, 507 aa, Human immunodeficiency virus
  variant (17)..(17): Xaa can be any naturally occurring amino acid
MGARASVLSGGKLDAWXKIRLRPGGKKKYRLKHIVWASRELERFAVNPGLLETSEGCRQILGQLQPSLQTGSEELKSLYNTIAVLYCVHQRIEIRDTKEALDKIEEEQNKSKKKAQQAAAAAADTGNSSQTSQNYPIVQNLQGQMVHQALSPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIIMGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSHITNSATVMMQRGTFRNQRKIVKCFNCGKEGHIARNCKAPRKKGCWKCGREGHQMKDCTERQANFLGKIWPSHKGRPGNFLQNRPEPTAPLEPTAPPEESFRRETIAPSQKQEPIDKELYPLASLRSLFGNDPSSQ

SEQ ID NO: 374 - protein, 510 aa, Human immunodeficiency virus
  variant (389)..(389): Xaa can be any naturally occurring amino acid
MGARASILSGGQLDRWEKIRLRPGGKKKYKLKHLVWASRELERFAVNPGLLETLDGCRQILGQLQPALQTGSEEFRSLYNTVATLYCVHGRIEVKDTKEALDKIEEEQNKSKKKAQQAAADTGNSGGNSSQVSQNYPIVQNLQGQMVHQAISPRTLNAWVKVVEEKAFSPEVIPMFTALSEGATPQDLNTMLNTVGGHQAAMQMLKETINEEAAEWDRLHPVQAGPNPPGQMREPRGSDIAGTTSTLQEQIGWMTSNPPIPVGEIYKRWIILGLNKIVRMYSPTSILDIRQGPKEPFRDYVDRFYKTLRAEQASAEVKGWMTETLLVQNANPDCKTILRALGPGATLEEMMTACQGVGGPSHKARVLAEAMGQVTNTAATMMMQKGNFXNQGKIVKCFNCGKTGHIAKNCRAPRKKGCWKCGKEGHQMKDCTERQANFLGKIWPSHKGRPGNFLQSRPEPTAPPAPTAPPAESFRFGEEATAPSQKPETRDELYPLASLKSLFGSDPSSQ

SEQ ID NO: 375 - protein, 497 aa, Human immunodeficiency virus
MGARASVLSGGELDRWEKIRLRPGGNKKYRLKHIVWASRELERFSINPGLLETSEGCRQILQQLQPSLQTGSEELKSLYNTIATLYCVHQRIDIKDTKEALEKVEEEQNKSKQKTQQAAADTRNSSQVSQNYPIVQNLQGQMVHQPLSPRTLNAWVKVVEEKAFSPEVIPMFSALSEGATPQDLNTMLNTVGGHQAAMQMLKETINEEAAEWDRLHPVHAGPVAPGQIREPRGSDIAGTTSTLQEQIAWMTNNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTGSANVMMQRGNFKSQRKIVKCFNCGKTGHIAKNCRAPRKKGCWKCGKEGHQMKDCNERQANFLGKVWPFHKERPGNFLQSRPEPTAPPEESFRFREETTAPSQKQEPIDKELYPLASLKSLFGNDP

SEQ ID NO: 376 - protein, 513 aa, Human immunodeficiency virus
MGARASVLSGGKLDQWEKIRLRPGGKKKYQLKHIVWASRELERFAVNPGLLETTEGCRQILGQLQPSLQTGSEELKSLYNTVAVLYCVHQRIDIKDTKEALDRIEEEQTKSKKQAQQKQAQQAAADTGSSSNVSQNYPIVQNMQGQLVHQAMSPRTLNAWVKVVEEKAFSPEVIPMFAALSEGATPQDLNTMLNTVGGHQAAMQMLKETINEEAAEWDRLHPIHAGPAAPGQMREPRGSDIAGTTSTLQEQIGWMTSNPPIQVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVNAATVMMQRGNFRSQRKIVKCFNCGKDGHIARNCKAPRRKGCWKCGKEGHQMKDCNNERQANFLGKIWPSHKGRPGNFLQNRPEPTAPSRTEPTAPPEESFRFGEETATSSQKQEPIDKGLYPLASLRSLFGNDPLSQ

SEQ ID NO: 377 - protein, 500 aa, Human immunodeficiency virus
MGARASVLSGGELDKWEKIRLRPGGKKKYRLKHIVWASRELERFAVNPGLLETSEGCRQILGQLQPSIKTGSEELKSLFNTVAVLYCVHQRIEVKDTKEALEKIEEEQNKCKKKVQQAAADTGNSSQVSQNFPIVQNMQGQMVHQAISPRTLNAWVKVVEEKAFSPEVIPMFSALSEGATPQDLNTMLNTVGGHQAAMQMLKETINEEAAEWDRLHPVQAGPIAPGQIREPRGSDIAGTTSTLQEQIAWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKSVKCFNCGKEGHIARNCRAPRKKGCWKCGKEGHQMKDCTERQANFLGKIWPSHKGRPGNFLQSRPEPSAPPEESFRFGEETTTPPQKQESKDKELYPLTSLKSLFGSDPSLQ

SEQ ID NO: 378 - protein, 505 aa, Human immunodeficiency virus
MGARASVLSGGKLDRWEKIRLRPGGKKKYKLKHIVWASRELERFAVNPGLLETAEGCRQILGQLQPSLQTGSEELKSLFNTVATLYCVHQNIEVKDTKEALDKVEEEQNKSKKKAQQAAADTGNNSQVSQNYPIVQNLQGQMVHQALSPRTLNAWVKVVEEKNFSPEVIPMFTALSEGATPQDLNTMLNTVGGHQAAMQMLKETINEEAAEWDRLHPVQAGPVAPGQIREPRGSDIAGTTSNLQEQIAWMTHNPPIPVGEIYKRWIILGLNKIVRMYSPTSILDIKQGPKEPFRDYVDRFYKTLRAEQASQDVKNWMTETLLVQNANPDCRTILKALGPAATLEEMMAACQGVGGPGHKARVLAEAMSQVTNSATIMMQKGNFRGQRKIVKCFNCGKEGHIAKNCRAPRKRGCWKCGKEGHQMKDCTERQANFLGKIWPSSKGRPGNFLQSRPEPTAPTAPTAPPEESFRFGEEMTPSQKQERIDKEPSPLASLRSLFGSDPSSQ

SEQ ID NO: 379 - protein, 510 aa, Human immunodeficiency virus
  variant (247)..(247): Xaa can be any naturally occurring amino acid
MGARASVLSGGELDRWERIRLRPGGNKRYKLKHIVWASRELERFAVNPGLLETSDGCRQILTQLQPSLQTGSEELKSLYNTVATLYCVHQRIEIKDTKEALDKIEEEQNKSKQKAQQAAAAAAADTGNSSQVSQNYPIVQNLQGQMVHQPIAARTLNAWVKVVEEKAFSPEVIPMFTALSEGATPQDLNTMLNTVGGHQAAMQMLKETINEEAAEWDRLHPVHAGPVAPGQLREPRGSDIAGTTSTXQEQIGWMTNNPPIPVGEIYKRWIVLGLNKIVRMYSPTSILDIKQGPKESFRDYVDRFYKTLRAEQASQEVKNWMTETLLVQNANPDCKTILKALGPGATLEEMMTACQGVGGPSHKARVLAEAMSQATNSSAIMMQKGNFRNQRKTVKCFNCGKEGHIARNCRAPRKKGCWKCGKEGHQMKDCTSGQANFLGRLWPSHKGRPGNFLQSRPEPTAPTAPPEESFRFVEETATPSQKQEKQEPIDREMYPLASLRSLFGNDPSSQ

SEQ ID NO: 380 - protein, 502 aa, Human immunodeficiency virus
  variant (59)..(59): Xaa can be any naturally occurring amino acid
  variant (102)..(102): Xaa can be any naturally occurring amino acid
  variant (129)..(130): Xaa can be any naturally occurring amino acid
  variant (133)..(133): Xaa can be any naturally occurring amino acid
  variant (144)..(144): Xaa can be any naturally occurring amino acid
  variant (437)..(437): Xaa can be any naturally occurring amino acid
  variant (445)..(445): Xaa can be any naturally occurring amino acid
  variant (466)..(466): Xaa can be any naturally occurring amino acid
MGARASVLSGGKLDRWEKIRLRPGGKKKYQLKHLVWASRELERFAVNPGLLESSEGCKXILIQLQPSLQTGSEELKSLYNTVATLYCVHQGIEIKDTKEALXKIEEEQNKSKKKAQQAAAAAADTGNSXXVSXNYPIVQNLQGXMVHQAISPRTLNAWVKVVEEKAFSPEVIPMFSALAEGATPQDLNTMLNTVGGHQAAMQMLKETINEEAAEWDRLHPVHAGPIAPGQMREPRGSDIAGTTSNLQEQIAWMTNNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPSHKARVLAEAMSQTNSASIMMQRGNFRSHKKTIKCFNCGKEGHIASKCRAPRKRGCWKCGKEGHQMKDCTERQANFLXKIWPPYKXRPGNFLQSRPEPTAPPEESFXFGEGTTTPPQKQEPIDKELYPLTSLKSLFGNDPSSQ

SEQ ID NO: 381 - protein, 505 aa, Human immunodeficiency virus
  variant (424)..(424): Xaa can be any naturally occurring amino acid
  variant (435)..(435): Xaa can be any naturally occurring amino acid
  variant (447)..(447): Xaa can be any naturally occurring amino acid
MGARASVLSGGGLDRWEKIRLRPGGKKKYRLKHIVWASRELERFAVNPALLESSGGCRQILQQLQPSLQTGSEELKSLFNTVAVLYCVHQRIDVKDTKEALDKIEEEQNKSKKKAQQAAADAADTGNSSSQVSQNYPIVQNLQGQMVHQALSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMGQVNSGAIMMQKGNFKSQRRNVKCFNCGKEGHIARNCRAPRKRGCWKCGKEGXQMKDCTERQAXFLGKLWPSHKGXPGNFPQSRPEPTAPPPPAESFRFGEEMTTPAQKQEPIDKETYPLASLRSLFGNDPSSQ

SEQ ID NO: 382 - protein, 500 aa, Human immunodeficiency virus
MGARASVLSGGKLDSWEKIRLRPGGKKKYKLKHIVWASRELERFAVNPSLLETSEGCRQIIGQLQPSLQTGSEELKSLYNTVATLYCVHQRIEVKDTKEALDKIEEEQNKSKKRAQLAAADTGSSSKVSQNYPIVQNIQGQMVHQPISPRTLNAWVKVVEEKAFSPEVIPMFSALAEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPVSILDIRQGPKEPFRDYVDRFYKTLRAEQASQDVKNWMTETLLVQNANPDCKTILKALGPGATLEEMMTACQGVGGPSHKARVLAEAMSLATNSNTIMMQRGNFKNQRKIVKCFNCGKEGHIAKNCRAPRKKGCWKCGREGHQMKDCTERQANFLGKIWPSHKGRPGNFLQSRPEPTAPPEESFRFGEETASPPQKQDQTDKELYPLASLKSLFGSDPSSQ

SEQ ID NO: 383 - protein, 497 aa, Human immunodeficiency virus
  variant (31)..(31): Xaa can be any naturally occurring amino acid
  variant (88)..(88): Xaa can be any naturally occurring amino acid
  variant (138)..(138): Xaa can be any naturally occurring amino acid
MGARASVLSGGELDRWEKIRLRPMGRKKYRXKHIVWASRELERFAVNPGLLETSEGCRQILAQLQPALQTGSEELRSLFNTVATLYCXHQRIDVKDTKEALEKIEEEQNKSKKKAQQAAADTGNSSQVSQNYPIVQNXQGQMVHQAISPRTLNAWVKVIEEKAFSPEVIPMFSALSEGATPQDLNTMLNTVGGHQAAMQMLKETINEEAAEWDRVHPVHAGPAAPGQMREPRGSDIAGTTSTLQEQIGWMTSNPPIPVGEIYKRWIILGLNKIVRMYSPISILDIRQGPKEPFRDYVDRFYKTLRAEQASQDVKNWMTETLLVQNANPDCKTILKALGPAATLEEMMTACQGVGGPSHKARILAEAMSQVTNSATIMMQKGNFRNQRRTVKCFNCGKEGHIARNCRAPRKKGCWKCGKEGHQMKDCTERQANFLGKIWPSHKGRPGNFLQSRPEPTAPPAESFRFGEETTTPPPKQEQVDNPLASLKSLFGNDPLSQ

SEQ ID NO: 384 - protein, 500 aa, Human immunodeficiency virus
  variant (46)..(46): Xaa can be any naturally occurring amino acid
  variant (57)..(57): Xaa can be any naturally occurring amino acid
  variant (225)..(225): Xaa can be any naturally occurring amino acid
  variant (228)..(228): Xaa can be any naturally occurring amino acid
  variant (388)..(388): Xaa can be any naturally occurring amino acid
  variant (446)..(446): Xaa can be any naturally occurring amino acid
  variant (486)..(486): Xaa can be any naturally occurring amino acid
MGARASVLSGGELDRWEKIRLRPGGKKKYRLKHIVWASRELERFAXNPGLLETSTGXRQILGQLQPSLQTGSEELKSLYNTVATLYCVHQKIEIRDTKEALDKIEEEQNKSKKKAQQAAADTGSSSQVSQNYPIVQNLQGQMVHQAISPRTLNAWVKVIEEKAFSPEVIPMFAALSEGATPQDLNTMLNTVGGHQAAMQMLKETINEEAAEWDRLHPVHAGPIAXGQXREPRGSDIAGTTSTLQEQIGWMTHNPPIPVGEIYKKWIIMGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQATNSVSIMMQKGNFRGQKXTVKCFNCGKEGHIAKNCRAPRKKGCWKCGREGHQMKDCTERQANFLGKIWPSHKGRPXNFLQNRTEPTAPPAESFGFGEETTTPPQKQEKIDKELYPXASLKSLFGNDQSSQ

SEQ ID NO: 385 - protein, 505 aa, Human immunodeficiency virus
MGARASILSGGELDRWEKIRLRPGGKKKYKLKHIVWASRELERFSINPGLLETSEGCRQILGQLHPSLQTGSEELKSLYNAIAVLFCVHQRIEVKDTKEALEKVEEEQNKSKKKAQQAAADTGNSSHTGNSSQVSQNYPIVQNIQGQMVHQALSPRTLNAWVKVIEEKAFSPEVIPMFSALSEGATPQDLNTMLNTVGGHQAAMQMLKETINEEAAEWDRLHPPQAGPVAPGQMRDPRGSDIAGTTSTLQEQIGWMTSNPPIPVGEIYKRWIIMGLNKIVRMYSPVSILDIRQGPKEPFRDYVDRFYKTLRAEQASQEVKNWMTETLLVQNANPDCKTILKALGPGATLEEMMTACQGVGGPGHKARVLAEAMSQVTNAGNIMMQKGNFRNQRKIVKCFNCGKEGHIAKNCRAPRKKGCWKCGKEGHQMKDCAERQANFLGKIWPSHKGRPGNFLQNRPEPTAPPEESFRFGEETTTPSQKQEVDKELYPLSSLKSLFGSDPSSQ

SEQ ID NO: 386 - protein, 500 aa, Human immunodeficiency virus
MGARASVLSGGELDRWEKIRLRPGGKKKYKLKHIVWASRELERFAVNPGLLETSGGCRQILEQLQPSLQTGSEELKSLFNTVAVLYCVHQRIEIKDTKEAIDKIEEEKAKSKKKAQQTAAAATGNSSQVSQNYPIVQNMQGQMVHQPISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIGWMTSNPPIQVGEVYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVNSATVMMQRGNFRNKRQTVKCFNCGKEGHIARNCKAPRKKGCWKCGKEGHQMKDCTERQANFLGKIWPSHKGRPGNFLQSRPEPTAPPAESFRFGEETTTPSQKQEPIDKELYPLASLKSLFGNDPSSQ

SEQ ID NO: 387 - protein, 500 aa, Human immunodeficiency virus
  variant (133)..(133): Xaa can be any naturally occurring amino acid
  variant (186)..(186): Xaa can be any naturally occurring amino acid
  variant (298)..(298): Xaa can be any naturally occurring amino acid
MGARASVLSGGELDKWEKIRLRPGGKKQYKLKHIVWASRELERFALNPGLLETSDGCRQILAQLQPSLQTGTEEIRSLYNTVATLYCVHQRIEVKDTKEALEKIEEEQNKSKKKEQQAAAGTGNSSQVSQNYXIVQNIQGQMVHQPLTPRTLNAWVKVVEEKSFSPEVIPMFTALSEGATPQDLNXMLNTVGGHQAAMQMLKETINEEAAEWDRLHPPQAGPIAPGQIREPRGSDIAGTTSNLQEQITWMTSNPPIPVGEIYKRWIILGLNKIVRMYSPTSILDIKQGPKEPFRDYVXRFYKTLRAEQASQDVKNWMTETLLVQNANPDCKTILKALGPGASLEEMMTACQGVGGPSHKARVLAEAMSQATNSANIMMQRGNFRNTRKTVKCFNCGKEGHIARNCRAPRKKGCWKCGQEGHQMKDCTERQANFLGKIWPSHKGRPGNFLQSRLEPTAPPEESLRFREETTTPSQKQEPTDKELYPLASLRSLFGNDPSSQ

SEQ ID NO: 388 - protein, 503 aa, Human immunodeficiency virus
  variant (332)..(332): Xaa can be any naturally occurring amino acid
MGARASVLSGGELDRWEKIRLRPGGKKQYRLKHLVWASRELERFAVNPSLLETSEGCRQILGQLQPALQTGSEELKSLYNTIATLYCVHQRIDVKDTKEALDKIEEEQNKSKKKAQQAQQAAAADTGNSSQVSQNYPIVQNLQGQMVHQALSPRTLNAWVKVVEEKAFSPEVIPMFTALSEGATPQDLNTMLNTVGGHQAAMQMLKETINEEAAEWDRLHPVQAGPIPPGQIREPRGSDIAGTTSTLQEQITWMTNNPPIPVGEIYKRWIILGLNKIVRMYSPVSILDIRQGPKEPFRDYVDRFYKTLRAEQASQDVKNWMTETLLVQNANXDCKTILKALGPACTLEEMMTACQGVGGPGHKARVLAEAMSQATHTAILMQRGNFKNQRKSVKCFNCGKEGHIARNCRAPRKKGCWKCGKEGHQMKDCTERQANFLGKIWPSHKGRPGNFLQSRPEPTAPPEESFRFGEEMPAPSQKQEPIDKELYPSAALRSLFGNDPLSQ

SEQ ID NO: 389 - protein, 504 aa, Human immunodeficiency virus
  variant (393)..(393): Xaa can be any naturally occurring amino acid
  variant (399)..(399): Xaa can be any naturally occurring amino acid
  variant (410)..(410): Xaa can be any naturally occurring amino acid
  variant (420)..(420): Xaa can be any naturally occurring amino acid
MGARASVLSGGELDRWEKIRLRPGGKKKYKLKHIVWASRELERFAVNPGLLETSEGCRQILGQLQPSLQTGSEELKSLFNTVAVLYCVHQKIEIKDTKEALDKIEEEQNKSKKKAQQAAAAADTGNNSQVSQNYPIVQNLQGQMVHQAISPRTLNAWVKVIEEKAFSPEVIPMFTALSEGATPQDLNTMLNTVGGHQAAMQMLKETINEEAAEWDRVHPVHAGPIAPGQMREPRGSDIAGTTSTLQEQIGWMTSNPPIPVGEIYKRWIILGLNKIVRMYSPVSILDIKQGPKEPFRDYVDRFYKTLRAEQASQDVKNWMTETLLVQNANPDCKTILKALGPAATLEEMMTACQGVGGPGHKARVLAEAMSQVTNSASAAIMMQRGNFRNQRKXVKCFNXGKEGHIAKNCXAPRKKGCWKXGREGHQMKDCTERQANFLGKIWPSHKGRPGNFLQSRPEPSAPPEESFRFGEETTTPSQKQEPRDKEMYPLASLRSLFGNDPLSQ

SEQ ID NO: 390 - protein, 499 aa, Human immunodeficiency virus
  variant (13)..(13): Xaa can be any naturally occurring amino acid
  variant (119)..(119): Xaa can be any naturally occurring amino acid
  variant (179)..(179): Xaa can be any naturally occurring amino acid
  variant (407)..(407): Xaa can be any naturally occurring amino acid
  variant (411)..(411): Xaa can be any naturally occurring amino acid
  variant (467)..(467): Xaa can be any naturally occurring amino acid
  variant (481)..(481): Xaa can be any naturally occurring amino acid
MGARASVLSGGKXDKWEKIRLRPGGKKKYKLKHIVWASRELERFAVNPGLLETSEGCRQILKQLQPSLETGSEELKSLYNTVAVLYCVHQRIEIRDTKEALDKIEEEQNKSKKEAQQTXAAGTGNSSQVSQNYPIVQNMQGQMVHQAISPRTLNAWVKVVEEKAFSPEVIPMFSALSEXATPQDLNTMLNTVGGHQAAMQMLKETINEEAAEWDRLHPAQAGPVAPGQVREPRGSDIAGTTSTLQEQIAWMTHNPPIPVGEIYKRWIILGLNKIVRMYSPTSILDIKQGPKEPFRDYVDRFYKTLRAEQSSQEVKNWMTETLLVQNANPDCKTILKALGPAATLEEMMTACQGVGGPAHKARVLAEAMSQATNSPAIMMQRGNFRNQRKIIKCFNCGKEGHLARNCXAPRXKGCWKCGKEGHQMKDCNNERQANFLGKIWPSCKGRPGNFLQSRPEPSAPPEESLRXGEETTTPSQKQESXDKEKYPLASLKSLFGNDP

SEQ ID NO: 391 - protein, 502 aa, Human immunodeficiency virus
  variant (44)..(44): Xaa can be any naturally occurring amino acid
  variant (55)..(55): Xaa can be any naturally occurring amino acid
  variant (59)..(59): Xaa can be any naturally occurring amino acid
  variant (63)..(63): Xaa can be any naturally occurring amino acid
  variant (110)..(110): Xaa can be any naturally occurring amino acid
  variant (117)..(117): Xaa can be any naturally occurring amino acid
  variant (127)..(127): Xaa can be any naturally occurring amino acid
  variant (158)..(158): Xaa can be any naturally occurring amino acid
  variant (263)..(263): Xaa can be any naturally occurring amino acid
  variant (294)..(294): Xaa can be any naturally occurring amino acid
  variant (297)..(297): Xaa can be any naturally occurring amino acid
  variant (329)..(329): Xaa can be any naturally occurring amino acid
  variant (333)..(333): Xaa can be any naturally occurring amino acid
  variant (359)..(359): Xaa can be any naturally occurring amino acid
  variant (375)..(375): Xaa can be any naturally occurring amino acid
MGARASVLSGGELDKWEKIRLRPGGKKQYKLKHIVWASRELERXAVNPGLLETAXGCRXILGXLHPSLQTGSEELRSLYNTVAVLYCVHQRIDVKDTKEALDKIEEEQNXSKKKAQXAAADTGNSSXSHVSQNYPIVQNLQGQMVHQAISPRTLNAWXKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEXYKRWIILGLNKIVRMYSPVSILDIRQGPKEXFRXYVDRFYKTLRAEQATQEVKNWMTETLLVQNSXPDCXTILKALGPAATLEEMMTACQGVGGPXHKARVLAEAMSQATNXAAIMMQRGNFRNQRKPIKCFNCGKEGHVARNCKAPRKKGCWKCGREGHQMKDCNERQANFLGKIWPSHKGRPGNFLQSRPEPSAPPEESFRFGEETATPSQKQEPIDKDLYPSASLRSLFGNDHSSQ

SEQ ID NO: 392 - protein, 500 aa, Human immunodeficiency virus
MGARASVLSGGELDRWEKIRLRPGGKKKYKLKHIVWASRELERFAVNPGLLETSDGCRQILGQLQPALQTGSEELKSLFNTVATLYCVHQKIDVKDTKEALDKIEEEQNKSKKKVQQAAADTGNSSQVSQNYPIVQNMQGQMVHQPLSPRTLNAWVKVVEEKAFSPEVIPMFTALSEGATPQDLNTMLNTVGGHQAAMQMLKETINEEAAEWNRLHPVHAGPVAPGQMREPRGSDIAGTTSNLQEQIGWMTNNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQVTNSAAVMMQKGNFRNQRKTVKCFNCGKEGHIARNCRAPRKRGCWKCGKEGHQMKDCTERQANFLGKIWPSQKGRPGNFLQSRPEPTAPPEESFRFGEEITAPSQKQELRDKEQHPLTSLRSLFGNDPLSQ

SEQ ID NO: 393 - protein, 500 aa, Human immunodeficiency virus
  variant (72)..(72): Xaa can be any naturally occurring amino acid
MGARASILSGGELDRWEKIRLRPGGKKKYRLKHIVWASRELERFAVNPGLLETSEGCRQILGQLQPSLQTGXEELRSLFNTVATLYCVHQKIDVKDTKEALEKIEEEQNKSKKKAQQVAADTGSNSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIAWMTNNPPIPVGDIYKRWIIMGLNKVVKMYSPTSILDIRQGPKEPFRDYVDRFYKTLRAEQASPEVKNWMTETLLVQNANPDCKTILKALGPAATLEEMMTACQGVGGPGHKARVLAEAMSQVTSSATIMMQKGNFRNQRKIVKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 394 - protein, 500 aa, Human immunodeficiency virus
MGARASVLSGGKLDKWEKIQLRPGGRKKYKLKHIVWASRELERFAVNPGLLETSEGCRQILGQLQPALQTGTEELRSLYNTVATLYCVHQRIEVKDTKEALEKIEEEQNKSKKKAQQVAADTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKIVKCFNCGKEGHIARNCRAPRKKGCWKCGKEGHQMKDCTERQANFLGKIWPSHKGRPGNFLQSRPEPTAPPEECFRFGEETTTPSQKQEPIDKELYPLTSLRSLFGNDPLSQ

SEQ ID NO: 395 - protein, 505 aa, Human immunodeficiency virus
  variant (48)..(48): Xaa can be any naturally occurring amino acid
  variant (267)..(267): Xaa can be any naturally occurring amino acid
  variant (392)..(392): Xaa can be any naturally occurring amino acid
  variant (436)..(436): Xaa can be any naturally occurring amino acid
MGARASILSGGELDKWERIRLRPGGKKKYKLKHLVWASRELERFAVNXGLLETAEGCRQILIGLQPSLQTGSEEFKSVYNTVATLYCVHQKIEIKDTKEALDKIEEEQNKSKKKAQQAAADTGNKGQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIXMGLNKIVRMYSPTSILDIKQGPKEPFRDYVDRFYRTLRAEQASQEVKNWMTETLLVQNANPDCKTILKALGPAATLEEMMTACQGVGGPAHKARVLAEAMSQVTNSANVMMQRGNFKNQRKIVKXFNCGKEGHIAKNCRAPRKKGCWKCGKEGHQMKDCTERQANFLGXIWPSHKGRPGNFLQNRPEPTAPPAPPEESFRFGEETATPPQKQEQIDRDRDLYPLASLRSLFGNDPSSQ

SEQ ID NO: 396 - protein, 500 aa, Human immunodeficiency virus
MGARASVLSGGELDRWEKIRLRPGGKKKYQLKHIVWASRELERYAVNPGLLETSEGCRQILGQLQPALHTGSEGFRSLYNTIAVLYCVHQKIEIKDTKEALDKIEEEQNKCKKKAQQAADTGNSNPVSQNYPIVQNLQGQMVHQPISPRTLNAWVKVVEEKAFSPEVIPMFAALSEGATPQDLNTMLNTVGGHQAAMQMLKETINEEAAEWDRLHPVQAGPVAPGQMREPRGSDIAGTTSTLQEQIGWMTHNPPIPVGEIYKKWIIMGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQATNSAAIMMMQKGNGRNQRKGVKCFNCGKEGHIARNCRAPRKKGCWKCGKEGHQMKDCTERQANFLGKIWPSHKGRPGNFLQNRPEPTAPPEESFRFGGETATPSQKQEPRDKELYPLTSLRSLFGNDPSSQ

SEQ ID NO: 397 - protein, 502 aa, Human immunodeficiency virus
  variant (112)..(112): Xaa can be any naturally occurring amino acid
  variant (118)..(118): Xaa can be any naturally occurring amino acid
  variant (380)..(380): Xaa can be any naturally occurring amino acid
MGARASVLSGGKLDRWEKIRLRPGGKKKYKLKHIVWASRELERFAVNPGLLETSAGCRQILEQLQPALQTGTEELRSLYNTIATLYCVHQQIDVKDTKEALEKIEEEQNKSXKKAQQXAADTGNSSQVSQNYPIVQNLQGQMVHQTISPRTLNAWVKVIEEKAFSPEVIPMFSALSEGATPQDLNTMLNTVGGHQAAMQMLKETINDEAAEWDRLHPVHAGPIAPGQMREPRGSDIAGTTSTLQEQIGWMTNNPPIPVGEIYKRWIILGLNKIVRMYSPISILDIKQGPKEPFRDYVDRFYKTLRAEQATQEVKNWMTETLLVQNANPDCKTMLKALGPAATLEEMMTACQGVGGPAHKARVLAEAMSQVTNPGTIMVQXGNFRNQRKTVKCFNCGKEGHIARNCRAPRKRGCWKCGKEGHQMKDCTERQANFLGKIWPSHKGRPGNFFQSRPEPTAPPEESFRFGEETTTPSQKQELIDKDKEQYPLASLRSLFGNDPSSQ

SEQ ID NO: 398 - protein, 506 aa, Human immunodeficiency virus
MGARASVLSGGELDRWEKIRLRPGSKKKYQLKHIVWASRELERFAVNPGLLETSDGCRQILGQLQPALQTGSEELRALYNTVATLYCVHQRIEVKDTKEALDKIEEEQNKSKRAQQAQQAAAAAADTGSSSSVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKAKILAEAMSQVTNAATIMMTQKGNFRNQRKIVKCFNCGKEGHIARNCRAPRKRGCWKCGKEGHQMKDCTERQANFLGKIWPSHKGRPGNFLQSRPEPTAPPEESFRFGEETITPSQKQEVMDKEVYPLTSLRSLFGNDPSSQ

SEQ ID NO: 399 - protein, 503 aa, Human immunodeficiency virus
  variant (322)..(322): Xaa can be any naturally occurring amino acid
  variant (496)..(496): Xaa can be any naturally occurring amino acid
MGARASILSGGELDRWEKIRLRPGGKKRYRLKHLVWASRELERFAVNPGLLETSEGCRQILGQLQPSLQTGSEELKSLFNTVATLYCVHQKIDVKDTKEALEKIEEEQNKSKKKAQPAAADTGKSSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIIMGLHKIVRMYSPTSILDIRQGPKEPFRDYVDRFYKTLRAEQASQEVKNWMTETLXVQNANPDCKTILKALGPAATLEEMMTACQGVGGPGHKARVLAEAMSQVTNSANIMMQKSSFRSPRKIVKCFNCGKEGHIARNCRAARKKGCWKCGKEGHQMKDCTERQANFLGKIWPSHKGRPGNFLQNRSEPTAPLEPTAPPAESFRFGEETTTPPQTQQPIEKELYPLTSLXSLFGNDP

SEQ ID NO: 400 - protein, 501 aa, Human immunodeficiency virus
MGARASVLSGGKLDKWEKIRLRPGGKKRYQLKHIVWASRELERFALNPGLLETSEGCRQILGQLQPALQTGTEELKSLFNTVATLYCVHQGIEVKDTKEALEKIEEEQNKSKKKAQQAAADTGNSSQVSQNYPIVQNLQGQMVHQALSPRTLNAWVKVVEEKAFSPEVIPMFSALSEGATPQDLNTMLNTVGGHQAAMQMLKETINEEAAEWDRLHPLHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPSHKARVLAEAMTQVTKPAATMMVQRGNFRNQRKIVKCFNCGKEGHIARNCRAPRKKGCWKCGKEGHQMKDCTERQANFLGKIWPSCKGRPGNFLQSRPEPTAPPEESFRFGEETTNPSQKQEPIDKELYPLTSLRSLFGNDPSSQ

SEQ ID NO: 401 - protein, 499 aa, Human immunodeficiency virus
  variant (6)..(6): Xaa can be any naturally occurring amino acid
  variant (91)..(91): Xaa can be any naturally occurring amino acid
  variant (115)..(115): Xaa can be any naturally occurring amino acid
  variant (159)..(159): Xaa can be any naturally occurring amino acid
  variant (163)..(163): Xaa can be any naturally occurring amino acid
  variant (193)..(193): Xaa can be any naturally occurring amino acid
  variant (210)..(210): Xaa can be any naturally occurring amino acid
  variant (230)..(230): Xaa can be any naturally occurring amino acid
  variant (286)..(286): Xaa can be any naturally occurring amino acid
  variant (295)..(295): Xaa can be any naturally occurring amino acid
  variant (328)..(328): Xaa can be any naturally occurring amino acid
  variant (331)..(331): Xaa can be any naturally occurring amino acid
  variant (362)..(362): Xaa can be any naturally occurring amino acid
  variant (410)..(410): Xaa can be any naturally occurring amino acid
  variant (420)..(420): Xaa can be any naturally occurring amino acid
  variant (441)..(441): Xaa can be any naturally occurring amino acid
MGARAXVLSGGELDRWEKIRLRPGGKKKYRLKHIVWASRELERFAVNPGLLETSEGCKQILGQLQPALQTGSEELRSLFNTVAVLYCVHRXIDVKDTKEALETIEEEQNKSKEKXQQAAADTGNSSQVSRNYPIVQNIQGQMVHQPLSPRTLNAWVKVXEEKXFSPEVIPMFSALSEGATPQDLNTMLNTVGXHQAAMQMLKETINEEAXEWDRLHPVHAGPIAPGQMRXPRGSDIAGTTSNLQEQIAWMTNNPPIPVGEIYKRWIILGLNKIVRMYSPTSILDIXQGPKEPFRXYVDRFYKTLRAEQATQEVKNWMTETLLVQNANXDCXTILKALGPAATLEEMMTACQGVGGPGHKARXLAEAMSQVTNSTIMMQKGNFRNQRKIVKCFNCGKEGHIARNCRAPRKXGCWKCGKEGXQMKDCTERQANFLGRIWPSSXGRPGNFLQNRPEPTAPPEESFRFGEETTTPSQKQGRIDTELYPLASLRSLFGNDPSSQ

SEQ ID NO: 402 - protein, 502 aa, Human immunodeficiency virus
MGARASVLSGGELDKWERIRLRPGGKKKYKLKHIVWASRELERFAVNPGLLETSEGCKQILEQLQPSLQTGSEEIKSLFNTVATLYCVHQRIDVRDTKEALDKIEEEQNKSKKVQLAATDKEKSGQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTHNPPIPVGDIYKRWIILGLNKIVRMYSPSSILDIKQGPKEPFRDYVDRFYKTLRAEQASQDVKNWMTETLLVQNANPDCKTILKALGPAATLEEMMTACQGVGGPSHKARVLAEAMSQVTSSSATIMMQRGNPRNQRKIVKCFNCGKEGHIARNCRAPRKKGCWKCGKEGHQMKDCTERQANFLGKIWPSHKGRPGNFLQSRPEPTAPPEESFRFGEETTTTTPSQKQEQKDKELYPLASLRSLFGNDPSSQ

SEQ ID NO: 403 - protein, 499 aa, Human immunodeficiency virus
MGARASVLSGGELDKWERIRLRPGGKKKYQLKHIVWASRELERFAVNPGLLETSEGCRQILGQLQPSLQTGSEELKSLYNTVATLYCVHQKIDIRDTKEALEKIEEEQNKSKKKAQQAATDTGNSNQVSQNYPIVQNLQGQMVHQPISPRTLNAWVKVVEEKAFNPEVIPMFSALSEGATPQDLNTMLNTVGGHQAAMQMLKETINEEAAEWDRTHPVHAGPVAPGQMREPRGSDIAGTTSNLQEQIGWMTSNPPIPVGEIYKRWIILGLNKIVRMYSPTSILDIRQGPKEPFRDYVDRFYKVLRAEQASQDVKNWMTETLLVQNANPDCKTILKALGPAATLEEMMTACQGVGGPGHKARVLAEAMSQVTNSATAAIMMQKGNFRTQRKIVKCFNCGKEGHIARNCRAPRKRGCWKCGKEGHQMKDCTERQANFLGKIWPSHKGRPGNFLQSRPEPTAPPEESFRFGEETATPSQKQEPIDKEMYPLASLKSLFGNDP

SEQ ID NO: 404 - protein, 498 aa, Human immunodeficiency virus
  variant (103)..(103): Xaa can be any naturally occurring amino acid
  variant (218)..(218): Xaa can be any naturally occurring amino acid
  variant (352)..(352): Xaa can be any naturally occurring amino acid
  variant (406)..(406): Xaa can be any naturally occurring amino acid
  variant (447)..(447): Xaa can be any naturally occurring amino acid
  variant (480)..(480): Xaa can be any naturally occurring amino acid
MGARASVLSAGELDRWERIRLRPGGKKKYRLKHIVWASRELERFAVNPGLLETSGGCRQILEQLQPSLQTGSEELKSLFNAVAVLYCVHQKIEVKDTKEALEXIEEEQNKSKKKAQQAAADAGNSSQVSQNYPIVQNLQGQMVHQPLSPRTLNAWVKVIEEKAFSPEVIPMFSALSEGATPQDLNTMLNTVGGHQAAMQMLKETINEEAAEWDRLHPXHAGPVAPGQMREPRGSDIAGTTSNLQEQITWMTNNPPIPVGEIYKRWIILGLNKIVRMYSPVSILDIRQGPKEPFRDYVDRFYKTLRAEQASQEVKNWMTETLLVQNANPDCKTILKALGPSASLEEMMTACQXVGGPGHKARVLAEAMSQVTKSPTIMVQGGNFRNQRKIVKCFNCGKEGHIARNCXAPRKKGCWKCGKEGHQMKDCSERQANFLGKIWSSHKGRPGXFLQSRPEPTAPPEESFRFGEETATPPQKQEDKXLYPLASLKSLFGNDPSSQ

SEQ ID NO: 405 - protein, 500 aa, Human immunodeficiency virus
  variant (44)..(44): Xaa can be any naturally occurring amino acid
  variant (244)..(244): Xaa can be any naturally occurring amino acid
MGARASVLSGGELDKWERIRLRQGGKKKYQLKHIVWASRELERXAVNPGLLETAEGCRQILGQLQPALQTGSEELRSLYNTVATLYCVHQKIEVKDTKEALEKIEEEQNKSKKKAQQAAADTGNSSQVSQNYPIVQNPQGQMIHQAISPRTLNAWVKVVEEKAFSPEVIPMFSALSEGATPQDLNTMLNTVGGHQAAMQILKETINEEAAEWDRMHPVHAGPIAPGQMREPRGSDIAGTTSTLXEQIGWMTNNPPIPVGEIYKRWIILGLNKIVRMYSPISILDIRQGPKEPFRDYVDRFYKTLRAEQASQDVKNWMTETLLVQNANPDCKTILKALGPAATLEEMMTACQGVGGPGHKARVLAEAMSQVTNSPAIMMQRGNFRNQRKTVKCFNCGREGHLARNCRAPRKKGCWKCGKEGHQMKDCTERQANFLGKIWSSHKGRPGNFLQSRPEPTAPPEESFRFGEETTTSSQKQEPIDKELYPLASLRSLFGSDPSSQ

SEQ ID NO: 406 - protein, 503 aa, Human immunodeficiency virus
  variant (114)..(114): Xaa can be any naturally occurring amino acid
  variant (125)..(125): Xaa can be any naturally occurring amino acid
  variant (486)..(486): Xaa can be any naturally occurring amino acid
MGARASVLSGGELDKWEKIRLRPGGKKKYRLKHIVWASRELERFAVNPGLLETSEGCRQILGQLHPALQTGSEELKSLYNTVATLYCVHQRIDVKDTKEALEKIEEEQNRSKKXAQQAAADTGSXNQVSQNYPIVQNMQGQLVHQPMSPRTLNAWVKVVEEKSFSPEVIPMFIALSEGATPQDLNTMLNTVGGHQAAMQMLKETINEEAAEWDRLHPVHAGPIAPGQMREPRGSDIAGTTSNLQEQIGWMTSNPPIQVGDIYKRWIVIGLNKIVRMYSPTSILDIKQGPKEPFRDYVDRFYKTLRAEQASQEVKNWMTETLLVQNANPDCKTILKALGPAATLEEMMTACQGVGGPSHKARVLAEAMSQATNSANIMMQRGNFRNQKKIVKCFNCGKEGHIAKNCRAPRKKGCWKCGKEGHQMKDCTERQANFLGKIWPSYKGRPGNFLQNRPEPTAPPAPPEESFRFGEEATTPSQKQDPIDKEXYPLDSLRSLFGNDPSSQ

SEQ ID NO: 407 - protein, 500 aa, Human immunodeficiency virus
  variant (389)..(389): Xaa can be any naturally occurring amino acid
MGARASVLSGGELDRWEKIRLRPGGKKQYRLKHIVWASRELERFAVNPGLLETSEGCRQILGQLQPSLQTGSEELRSLYNTIAVLYCVHQKIEVKDTKEALDKIEEEQNKSKKQAQQAAADAGKSKQVSQNFPIVQNLQGQMVHQALSPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKHWMTETLLVQNANPDCKTILKALGSGATLEEMMTACQGVGGPGHKARVLAEAMSQVTSPATIMLQKGNFRNQRKXVKCFNCGKEGHIARNCRAPRKKGCWKCGKEGHQMKDCTERQANFLGKIWPSHRGRPGNFLQSRPEPTAPPEESFRFGGETTTPPQKQEPIDKELYPLASLKSLFGNDPSSQ

SEQ ID NO: 408 - protein, 503 aa, Human immunodeficiency virus
  variant (76)..(76): Xaa can be any naturally occurring amino acid
MGARASVLSGGELDRWEKIRLRPGGKKKYRLKHIVWASRELERFAVNPGLLETSEGCRQILGQLQSSLKTGSKELXSLYNTVATLYCVHQQIEVRDTTEALDKIEEEQNKSKKKAQQEQQAAADAGNRNQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIAWMTNNPPIPVGDIYKRWIILGLNKIVRMYSPTSILDIKQGPKEPFRDYVDRFYKVLRAEQGSQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKRGCWKCGKEGHQMKDCTERQANFLGKIWPSHKGRPGNFLQSRPEPSAPPEESFRFGEEVTTPSQKQEPADKEQYPLASLRSLFGNDPSSQ

SEQ ID NO: 409 - protein, 504 aa, Human immunodeficiency virus
  variant (129)..(129): Xaa can be any naturally occurring amino acid
  variant (430)..(430): Xaa can be any naturally occurring amino acid
  variant (473)..(473): Xaa can be any naturally occurring amino acid
MGARASILSGGKLDKWESIRLRPGGKKKYRLKHIVWASRELERFAVNPGLLETSEGCRQILRQLQPSLQTGSEELRSLYNTVATLYCVHQRIEVKDTKEALDKIEEEQNESKRKKQQAVADTGNSTQNXKQDSQNYPIVQNLQGQMVHQAMSPRTLNAWVKVVEEKAFSPEVIPMFVALSEGATPQDLNTMLNTVGGHQAAMQMLKETINEEAAEWDRLHPVHAGPIAPGQMREPRGSDIAGTTSTLQEQIGWMTSNPPTPVGEIYKRWIVMGLNKIVRMYSPTSILDIKQGPKEPFRDYVDRFYKTLRAEQASQEVKNWMTETLLVQNANPDCRTILKALGPAATLEEMMTACQGVGGPGHKARVLAEAMSQVTNSATIMMQRDNFRNQRKIVKCFNCGKQGHIAKNCRAPRKKGCWKCGKEGHQMKDXNERQANFLGKIWPSHKGRPGNFLQNRPEPTAPPEESFRFGEEXTTPPQKQEPIDQGMYPLASLKSLFGNDPSSQ

SEQ ID NO: 410 - protein, 500 aa, Human immunodeficiency virus
  variant (42)..(42): Xaa can be any naturally occurring amino acid
  variant (95)..(95): Xaa can be any naturally occurring amino acid
  variant (164)..(164): Xaa can be any naturally occurring amino acid
  variant (218)..(218): Xaa can be any naturally occurring amino acid
  variant (258)..(258): Xaa can be any naturally occurring amino acid
  variant (268)..(268): Xaa can be any naturally occurring amino acid
  variant (271)..(271): Xaa can be any naturally occurring amino acid
  variant (293)..(293): Xaa can be any naturally occurring amino acid
  variant (344)..(344): Xaa can be any naturally occurring amino acid
  variant (473)..(474): Xaa can be any naturally occurring amino acid
  variant (479)..(479): Xaa can be any naturally occurring amino acid
MGARASVLSGGKLDKWEKIQLRPGGRKRYRLKHIVWASRELXRFAINPGLLETSEGCRQIIAQLQSALQTGSEELRSLYNTVATLYCVHQKIDIXDTKEALERIEEEQNKSKKKAQQATADIGNSSQVSQNYPIVQNMQGQMVHQPISPRTLNAWVKVVEEKAXSPEVIPMFSALSEGATPQDLNTMLNTVGGHQAAMQMLKEAINEEAAEWDRLHPXHAGPIAPGQMREPRGSDIAGTTSTLQEQIGWMTNNPPIPXGEIYKRWIIXGLXKIVRMYSPTSILDIKQGPKEPXRDYVDRFYKTLRAEQASQEVKNWMTETLLVQNSNPDCKTILKALGPAATLXEMMTACQGVGGPGHKARVLAEAMSQVTNSATIMMQRGNFKGQRKTVKCFNCGREGHIAKNCRAPRKKGCWKCGKEGHQMKDCTERQANFLGKIWPSSKGRPGNFLQSRPEPTAPPEESFRFGEETTTPXXKQEQXDKELYPGASLKSLFGSDPLLQ

SEQ ID NO: 411 - protein, 500 aa, Human immunodeficiency virus
MGARASVLSGGELDRWEKIRLRPGGKKKYKLKHVVWASRELERFAVNPGLLETSEGCRQILAQIQPALQTGSEELRSLYNTVATLYCVHQRIEVKDTREAVEKIEEEQNKSKKKTQQAAANTGNSSQVSQNYPIVQNIQGQMVHQAISPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPSSILDIRQGPKEPFRDYVDRFYKTLRAEQASQEVKNWMTETLLVQNANPDCKTILKALGPAATLEEMMTACQGVGGPSHKARVLAEAMSQVTTSATIMTQRGNLRNQRKSVKCFNCGKEGHIARNCRAPRKRGCWKCGKEGHQMKDCTERQANFLGKIWPSHKGRPGNFLQSRPEPTAPPEESFRFGKGTTTLSQKQEQKDEELYPLASLRSLFGNDPSSQ

SEQ ID NO: 412 - protein, 495 aa, Human immunodeficiency virus
  variant (429)..(429): Xaa can be any naturally occurring amino acid
MGARASVLSGGELDRWEKIRLRPGGKKKYRLKHIVWASRELERYAVNPGLLETSEGCRQILGQLQPALQTGSEGFRSLYNTIATLYCVHQKMDVKDTKEALDKIEEEQNKSKKKAQQAAAGTGNSSQVSQNYPIVQNIQGQMVHQPISPRTLNAWVKVVEEKAFSPEVIPMFSALSEGATPQDLNTMLNTVGGHQAAMQMLKETINEEAAEWDRMHPVHAGPVAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSASIMMQKGNFRNQRKIIKCFNCGKEGHLAKNCRAPRKKGCWKCGKEGHQMKDCTEXQANFLGKIWPSHKGRPGNFLQSRPEPTAPPEESFREEITAPPQRQEPIDKELYPLASLKSLFGNDP

SEQ ID NO: 413 - protein, 499 aa, Human immunodeficiency virus
  variant (28)..(28): Xaa can be any naturally occurring amino acid
  variant (74)..(74): Xaa can be any naturally occurring amino acid
  variant (254)..(254): Xaa can be any naturally occurring amino acid
  variant (279)..(279): Xaa can be any naturally occurring amino acid
  variant (302)..(302): Xaa can be any naturally occurring amino acid
MGARASVLSAGELDRWEKIRLRPGGKKXYRLKHIVWASRELERFAVNPGLLETSDGCRQILGQLQPSLQTGSEXLRSLYNTVATLYCVHQKIEIKDTKEALEKVEEEQNKSKNKAQQAAADTGNSSQVSQNYPIVQNLQGQMMHQAISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNXPIPVGEIYKRWIILGLNKIVRMYSXTSILDIRQGPKEPFRDYVDRFYXTLRAEQASQEVKNWMTETLLVQNSNPDCKTILKALGPGATLEEMMTACQGVGGPGHKARVLAEAMSQVTNPGTIMMQRGNFKNQKKIKCFNCGREGHLARNCRAPRKKGCWKCGKEGHQMKDCTERQANFLGKIWPSSKGRPGNFLQNRTEPTAPPEESLRFGEETATPSQKQGPIDKELYPLASLRSLFGNDPSSQ

SEQ ID NO: 414 - protein, 500 aa, Human immunodeficiency virus
  variant (11)..(11): Xaa can be any naturally occurring amino acid
  variant (31)..(31): Xaa can be any naturally occurring amino acid
  variant (55)..(55): Xaa can be any naturally occurring amino acid
  variant (197)..(197): Xaa can be any naturally occurring amino acid
  variant (229)..(229): Xaa can be any naturally occurring amino acid
  variant (298)..(298): Xaa can be any naturally occurring amino acid
  variant (349)..(349): Xaa can be any naturally occurring amino acid
  variant (364)..(364): Xaa can be any naturally occurring amino acid
  variant (381)..(381): Xaa can be any naturally occurring amino acid
MGARASVLSGXELDRWEKIRLRPGGKKKYKXKHIVWASRELERFAVNPGLLETSXGCKQILEQLQPALQTGSEELRSLFNTVATLYCVHQRIDVKDTKEALEKIEEEQNKSKKKVQQAAADTGNSSQVSQNYPIVQNIQGQMVHQPLSPRTLNAWVKVVEEKAFSPEVIPMFTALSEGATPQDLNTMLNTVGGHQAXMQMLKETINEEAAEWDRLHPVHAGPIAPGQMXEPRGSDIAGTTSNLQEQIGWMTNNPPIPVGEIYKRWIILGLNKIVRMYSPTSILDIKQGPKEPFRDYVXRFYKTLRAEQASQEVKNWMTETLLVQNANPDCKTILKALGPAATLEEMMTXCQGVGGPGHKARVLXEAMSQVTNSATIMMQKXNFRNQRKIVKCFNCGKEGHIARNCRAPRKRGCWKCGKEGHQMKDCTERQANFLGKIWPSYKGRPGNFLQSRPEPTAPPEESFRFGEETTTPAQKQEPVDKELYPSASLRSLFGNDPSSQ

SEQ ID NO: 415 - protein, 503 aa, Human immunodeficiency virus
  variant (96)..(96): Xaa can be any naturally occurring amino acid
  variant (329)..(329): Xaa can be any naturally occurring amino acid
MGARASVLSGGELDRWEKIRLRPGGKKKYQLKHIVWASRELERFAVNPGLLETSDGCRQILGQLQPALQTGSEELKSLYNTVATLYCVHQRIEIKXTKEALEKIEEEQNKSKKKVQQAQQVAADTENSSQVSQNYPIVQNIQGQMVHQPLSPRTLNAWVKVVEEKAFSPEVIPMFTALSEGATPQDLNTMLNTVGGHQAAMQMLKETINEEAAEWDRMHPVHAGPIAPGQMREPRGSDIAGTTSNLQEQIGWMTNNPPIPVGEIYKRWIILGLNKIVRMYSPSSILDIKQGPKEPFRDYVDRFYKTLRAEQASQEVKNWMTETLLVQNXNPDCKTILKALGPAATLEEMMTACQGVGGPAHKARVLAEAMSQVTNSATATIMMQRGKVRNQRRMIKCFNCGKEGHIARNCRAPRKKGCWKCGKEGHQMKDCTERQANFLGKIWPSHKGRPGNFLQSRPEPTAPPEESFRFGEESPSQKQDLIDKEQYPLTSLRSLFGNDPSSQ

SEQ ID NO: 416 - protein, 502 aa, Human immunodeficiency virus
MGARASVLSGGELEKWERIRLRPGGKKQYRLKHIVWASRELERFAINPVFLETADGCIQILGQLQPALQTGSEEIRSLYNTVATLYCVHQKIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNSAATVMMQKGNFRNQRKPVKCFNCGREGHLARHCRAPRKKGCWKCGKEGHQMKDCTERQANFLGKIWSSHKGGRPGNFLQSRPEPTAPPEESFRFGEETTTPPQKQEPIDKEVYPLTALKSLFGNDPSSQ

SEQ ID NO: 417 - protein, 500 aa, Human immunodeficiency virus
  variant (67)..(67): Xaa can be any naturally occurring amino acid
  variant (144)..(144): Xaa can be any naturally occurring amino acid
  variant (246)..(246): Xaa can be any naturally occurring amino acid
  variant (385)..(385): Xaa can be any naturally occurring amino acid
  variant (464)..(464): Xaa can be any naturally occurring amino acid
  variant (477)..(477): Xaa can be any naturally occurring amino acid
MGARASVLSGGELDRWEKIRLRPGGKKKYKLKHIVWASRELERFAVNPGLLETAEGCRQILGQLQPXLQTGSEELKSLHNTIATLYCVHQRIDVKDTKEALEKIEEEQNKSKKKVQQAAADTGNSSQVSQNYPIVQNLQGQMVXQALSPRTLNAWVKVVEEKAFSPEVIPMFSALSEGATPQDLNTMLNTVGGHQAAMQMLKETINEEAADWDRLHPVHAGPVAPGQLREPRGSDIAGTTSTLQEXIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSTTVMMQRGNFRXQRKSVKCFNCGREGHIAKNCRAPRKKGCWKCGKEGHQMKDCTERQANFLGKIWPSYKGRPGNFLQSRPEPTAPPEESFXFGEETTASSQKQXPIDKDLYPLTSLRSLFGNDPSSQ

SEQ ID NO: 418 - protein, 498 aa, Human immunodeficiency virus
  variant (25)..(25): Xaa can be any naturally occurring amino acid
  variant (155)..(155): Xaa can be any naturally occurring amino acid
  variant (204)..(204): Xaa can be any naturally occurring amino acid
  variant (215)..(215): Xaa can be any naturally occurring amino acid
  variant (224)..(224): Xaa can be any naturally occurring amino acid
  variant (253)..(253): Xaa can be any naturally occurring amino acid
  variant (336)..(336): Xaa can be any naturally occurring amino acid
  variant (340)..(340): Xaa can be any naturally occurring amino acid
  variant (388)..(388): Xaa can be any naturally occurring amino acid
MGARASVLSGGELDKWEKIRLRPGXKKKYQLKHIVWASRELERFAVNPGLLETAEGCRQILGQLQPSLQTGSEELRSLFNTVATLYCVHSKIEVKDTKEALEKIEEEQNKSKKKAQQAAAADTGNSSNVSQNYPIVQNLQGQMVHQSLSPRTLNXWVKVVEEKGFNPEVIPMFTALSEGATPQDLNTMLNTVGGHQAAMQMLKXTINEEAAEWDXLHPVHAGPXAPGQMREPRGSDIAGTTSNLQEQIAWMTXNPPVPVGEIYKRWIILGLNKIVRMYSPTSILDIKQGPKEPFRDYVDRFYKTLRAEQASQDVKNWMTETLLVQNANPDCKTILXAMGXGASLEEMMTACQGVGGPGHKARVLAEAMSQVTNSTTIMMQRGNFRKQXKIVKCFNCGKEGHIARNCRAPRKKGCWKCGKEGHQMKDCTERQANFLGKIWPSYKGRPGNFLQNRPEPTAPPEESFSFGEETTAPPQKQEPINKELYPSTSLRSLFGNDP

SEQ ID NO: 419 - protein, 498 aa, Human immunodeficiency virus
  variant (93)..(93): Xaa can be any naturally occurring amino acid
  variant (158)..(158): Xaa can be any naturally occurring amino acid
  variant (257)..(257): Xaa can be any naturally occurring amino acid
  variant (262)..(262): Xaa can be any naturally occurring amino acid
MGARASVLSGGELDKWERIRLRPGGRKKYQLKHIVWASRELERFALNPGLLETAEGCRQILGQIQPALQTGSEELKSLHNTVAVLYCVHQKIXVRDTKEALEKIEEEQNKSKKKQQAAADTGSSSQVSQNYPIVQNLQGQMVHQAISPRTLNAWVKVXEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPXGEIYXRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVNSPAIMMQRGNFKGQRKIVKCFNCGKEGHIARNCRAPRKKGCWKCGKEGHQMKDCTERQANFLGKIWPSSKGRPGNFLQNRTEPTAPPEESFRFGEETTTPSQKQDQKDKELYPLASLRSLFGSDPSSQ

SEQ ID NO: 420 - protein, 500 aa, Human immunodeficiency virus
MGARASVLSGGELDRWEKIRLRPGGKKKYRLKHIVWASRELERFAVNPGLLETSEGCRQILGQLQPALQTGSEELRSLYNTVATLYCVHQKIEVKDTKEALEKIEEEQNKSKKKAQQAAADTGNSSKVSQNYPIVQNIQGQMVHQPIAPRTLNAWVKVVEEKAFSPEVIPMFSALSEGATPQDLNTMLNTIGGHQAAMQMLKETINEEAAEWDRLHPVQAGPIAPGQLREPRGSDIAGTTSTLQEQMTWITNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRKQRKIIKCFNCGKEGHLARNCRAPRKKGCWKCGKEGHQMKDCTERQANFLGKIWPSYKGRPGNFLQSRPEPTAPPEESFRFGEKTITPSQKQEPIDKELYPLTSLRSLFGNDPSSQ

SEQ ID NO: 421 - protein, 502 aa, Human immunodeficiency virus
MGARASVLSGGELDRWEKIRLRPGGKKKYRLKHIVWASRELERFALNPGLLETSEGCRQILGQLQPALQTGSEEFRSLYNTVATLYCVHQKIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKDTINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKAKILAEAMSQVTNSASASIMMQRGNFRNQKRVIKCFNCGKEGHLAKNCRAPRKRGCWKCGKEGHQMKDCTERQANFLGRIWPSLKGRPGNFLQNRPEPSAPPEESFRFGEETTTPSQKQEPIDKELYPLASLKSLFGNDPSSQ

SEQ ID NO: 422 - protein, 500 aa, Human immunodeficiency virus
  variant (55)..(55): Xaa can be any naturally occurring amino acid
  variant (61)..(61): Xaa can be any naturally occurring amino acid
  variant (235)..(235): Xaa can be any naturally occurring amino acid
  variant (371)..(371): Xaa can be any naturally occurring amino acid
  variant (483)..(483): Xaa can be any naturally occurring amino acid
MGARASVLSGGELDKWEKIRLRPGGKKKYKLKHIVWASRELERFAVNPGLLETSXGCRQIXGQLQPALQTGSEELKSLYNTVATLYCVHQRIEVKDTKEALEKIEEEQNRSKKKAQQAAADTGNSSQVSQNYPIVQNIQGQMVHQAISPRTLNAWVKVVEEKAFSPEVIPMFSALSEGATPQDLNTMLNTVGGHQAAMQMLKETINDEAAEWDRLHPVHAGPIAPGQMREPRGSXIAGTTSTLQEQIGWMTNNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQVXNPTTVMMQRGNLRNQRKIVKCFNCGKEGHIARNCRAPRKRGCWKCGKEGHQMKDCTERQANFLGKIWPSSKGRPGNFLQSRPEPTAPPEESFRFGEETTTPSQKQEPMDKEXHPLASLRSLFGNDPSSQ

SEQ ID NO: 423 - protein, 502 aa, Human immunodeficiency virus
  variant (18)..(18): Xaa can be any naturally occurring amino acid
  variant (47)..(47): Xaa can be any naturally occurring amino acid
  variant (55)..(55): Xaa can be any naturally occurring amino acid
  variant (62)..(62): Xaa can be any naturally occurring amino acid
  variant (68)..(68): Xaa can be any naturally occurring amino acid
  variant (84)..(84): Xaa can be any naturally occurring amino acid
  variant (88)..(88): Xaa can be any naturally occurring amino acid
  variant (122)..(122): Xaa can be any naturally occurring amino acid
  variant (125)..(125): Xaa can be any naturally occurring amino acid
  variant (173)..(173): Xaa can be any naturally occurring amino acid
  variant (186)..(186): Xaa can be any naturally occurring amino acid
  variant (216)..(216): Xaa can be any naturally occurring amino acid
  variant (246)..(246): Xaa can be any naturally occurring amino acid
  variant (256)..(256): Xaa can be any naturally occurring amino acid
  variant (283)..(283): Xaa can be any naturally occurring amino acid
  variant (286)..(286): Xaa can be any naturally occurring amino acid
  variant (298)..(298): Xaa can be any naturally occurring amino acid
  variant (302)..(302): Xaa can be any naturally occurring amino acid
  variant (309)..(309): Xaa can be any naturally occurring amino acid
  variant (337)..(337): Xaa can be any naturally occurring amino acid
  variant (357)..(357): Xaa can be any naturally occurring amino acid
  variant (366)..(366): Xaa can be any naturally occurring amino acid
  variant (457)..(457): Xaa can be any naturally occurring amino acid
  variant (500)..(500): Xaa can be any naturally occurring amino acid
MGARASVLSGGELDRWEXIRLRPGGKKKYRLKHIVWASRELERFAVXPGLLETSXGCRQILXQLQPAXQTGSEELKSLYNTVAXLYCXHQRIDVKDTKEALERIEEEQNKSKKKAQPAAADXGNXSQVSQNYPIVQNIQGQMVHQAISPRTLNAWVKVIEEKAFSPEVIPMFXALSEGATPQDLNXMLNTVGGHQAAMQMLKETINEEAAEWDRMXPVHAGPIAPGQMREPRGSDIAGTTSTLQEXIGWMTSNPPXPVGEIYKRWIILGLNKIVRMYSPVSIXDIXQGPKEPFRDYVXRFYXTLRAEQXTQEVKNWMTETLLVQNSNPDCKTILKAXGPAATLEEMMTACQGVGGPXHKARVLAEXMSQVTNSTAIMMQKGNFRNQRRTVKCFNCGKEGHIAKNCRAPRKRGCWKCGKEGHQMKDCTERQANFLGKIWPSHKGRPGNFLQSRPEPTXPPEESFRFGEETATPSQKQELINLDQELYPSASLKSLFGNDPXSK

SEQ ID NO: 424 - protein, 500 aa, Human immunodeficiency virus
  variant (83)..(83): Xaa can be any naturally occurring amino acid
  variant (138)..(138): Xaa can be any naturally occurring amino acid
MGARASVLSGGKLDKWEKIRLRPGGKKKYKLKHIVWASRELERFAVNPGLLETSDGCRQILGQLQPALQTGSEELKSLYNTVXTLYCVHQRIEIQDTKEALEKIEEEQNKSKKKAQQVAADTGNSSQASQNYPIVQNXQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIDWMTHNPPIPVGEIYKRWIILGLNKIVRMYSPSSILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGKFKNQRKIVKCFNCGKEGHIARNCRAPRKRGCWKCGKEGHQMKDCTERQANFLGKIWPSYKGRPGNFLQSRLEPTAPPEESFRFGEETTTLSQKQESIDKELHPLTSLRSLFGNDPSSQ

SEQ ID NO: 425 - protein, 500 aa, Human immunodeficiency virus
MGARASVLSGGELDRWERIRLRPGGKKQYKLKHIVWASRELERFAVNPGLLETSEGCRQILGQLQPSLQTGSEELKSLYNTVATLYCVHQRIEVKDTKEALEKIEEEQNKSKRKAQQAAADTGNSSQVSQNYPIVQNPQGQMIHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPVSILDIKQGPKEPFRDYVDRFYKTLRAEQASQEVKNWMTETLLVQNANPDCKTILKALGPGATLEEMMTACQGVGGPSHKARVLAEAMSQATNAATIMMQRGNFRNQRKIIKCFNCGKEGHLAKNCKAPRKKGCWKCGKEGHQMKECTERQANFLGKIWPSYKGRPGNFPQSRLEPTAPPEESFRFGEKTTTPSQKQEPIDKELYPSTSLRSLFGNDPSSQ

SEQ ID NO: 426 - protein, 500 aa, Human immunodeficiency virus
MGARASVLSGGELDKWEKIRLRPGGKKKYRLKHIVWASRELERFAVNPGLLETSDGCRQILKQLQPSLQTGSEELKSLYNTVATLYCVHQRKDVKDTKEALEKIEEEQNKSREKAQLAAADTGNSSPASQNYPIVQNLQGQAVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLIQNANPDCKTILKALGPAATLEEMMTACQGVGGPGHKARVLAEAMSQVTNSATIMMQKGNFRNQKKVVKCFNCGKEGHIARNCRAPRKKGCWKCGKEGHQMKDCTERQANFLGKIWPSRKGRPGNFLQSRPEPTAPPEESFRVGEETATPSQRQETIDKELCPLPSLRSLFGNDPSSQ

SEQ ID NO: 427 - protein, 502 aa, Human immunodeficiency virus
MGARASVLSGGKLDRWEKIRLRPGGKKKYKLKHIVWASRELERFAVNPGLLETSEGCRQILGQLQPALRTGSEELRSLYNTIATLYCVHQQIEVKDTKEALEKIEEEQNKSKKKVQQAAADTGNSSQNSQNYPIVQNVQGQMVHQAISPRTLNAWVKVIEEKAFSPEVIPMFSALSEGATPQDLNTMLNTVGGHQAAMQILKETINEEAADWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATMMMQRGNYRHQKKIVKCFNCGREGHIAKNCRAPRKKGCWKCGKEGHQMKDCTERQANFLGKIWPSYKGRPGNFLQSRPEPTAPPEESFRFGEETTTTSQKQKQETVDKELYPLTSLRSLFGNDPSSQ

SEQ ID NO: 428 - protein, 500 aa, Human immunodeficiency virus
  variant (412)..(412): Xaa can be any naturally occurring amino acid
  variant (427)..(427): Xaa can be any naturally occurring amino acid
  variant (431)..(431): Xaa can be any naturally occurring amino acid
  variant (437)..(437): Xaa can be any naturally occurring amino acid
MGARASVLSGGELDKWEKIRLRPGGKKKYKLKHIVWASRELERFAVNPGLLETSSGCRQILEQLQPSLQTGSEELRSLYNTVATLYCVHQKIEVKDTKEALEKVEEEQNKSKKKAQQAAADTGNSSKVSQNYPIVQNVQGQMVHQPISPRTLNAWVKVVEEKAFSPEVIPMFSALSEGATPQDLNTMLNTVGGHQAAMQMLKETINEEAAEWDRMHPVHAGPIAPGQMREPRGSDIAGTTSNLQEQIAWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSTTIMMQRGTLRNQRKIVKCFNCGKEGHIARNCRAPRKKXCWKCGREGHQMKDCXERQXNFLGKXWPSRKGRPGNFLQSRPEPTAPPEESFRFGEETTPPSQKQELIDKEAYPLASLRSLFGNDPSSQ

SEQ ID NO: 429 - protein, 500 aa, Human immunodeficiency virus
  variant (464)..(464): Xaa can be any naturally occurring amino acid
MGARASVLSGGGLDRWEKIRLRPGGKKKYRLKHIVWASRELERFAVNPGLLETPEGCRQILGQLQPALQTGSEELKSLFNTVATLYCVHQKIEVRDTKEALEKIEEEQNKSKKKAQQAVADTGNSSQVSQNYPIVQNIQGQMVHQAMSPRTLNAWVKVVEEKAFSPEVIPMFAALSEGATPQDLNTMLNTVGGHQAAMQMLKETINEEAAEWDRLHPVHAGPIAPGQMREPRGSDIAGTTSNLQEQIGWMTSNPPIPVGEIYKRWIIMGLNKIVRMYSPTSILDIRQGPKEPFRDYVDRFYKTLRAEQASQEVKNWMTETLLVQNANPDCRTILKALGPAATLEEMMTACQGVGGPGHKARVLAEAMSQVTNSATIMMQRGNGRTQRKIVKCFNCGKEGHIARNCRAPRKRGCWKCGKEGHQMKDCTERQANFLGKIWPSYKGRPGNFLQNRPEPTAPPEESFXFGDETTTPSQKQEPIDKDLYPSASLRSLFGNDPSSQ

SEQ ID NO: 430 - protein, 501 aa, Human immunodeficiency virus
MGARASVLSGGQLDRWEKIRLRPGGKKKYRLKHIVWASRELERFAVNPGLLETAGGCRQILEQLQPSLQTGSEELRSLYNTVATLYCVHQKLEVKDTKEALDKIEEEQNKSKKKAQQAAAAADTGNNSKVSQNYPIVQNLQGQMVHQSLSPRTLNAWVKVIEEKAFSPEIIPMFTALSEGATPQDLNTMLNTVGGHQAAMQMLKETINEEAAEWDRVHPVQAGPVAPGQIREPRGSDIAGTTSNLQEQIAWMTNNPPIPVGEIYKRWIILGLNKIVRMYSPVSILDIRQGPKEPFRDYVDRFYKTLRAEQASQEVKNWMTETLLVQNSNPDCKHILKALGPGATLEEMMTACQGVGGPSHKARVLAEAMSQVTNPTTIMMQRGNFKQRKTIKCFNCGKEGHTARNCRAPRKKGCWKCGKEGHQMKDCTERQANFLGKIWPSHKGRPGNFLQSRPEPTAPPEESFRFGEGTATPSQKQGPIDEELYPLASLKSLFGNDPSSQ

SEQ ID NO: 431 - protein, 500 aa, Human immunodeficiency virus
  variant (76)..(76): Xaa can be any naturally occurring amino acid
  variant (147)..(147): Xaa can be any naturally occurring amino acid
MGARASVLSGGELDRWEKIRLRPGSKKKYRLKHLVWASRELERFAVNPGLLETSEGCRQILAQLQPALQTGSEELXSLYNTVATLYCVHQKIEIKDTKEALDRIEEEQNRSKKRAQQAAADTGSSSQVSQNYPIVQNMQGQMVHQPXTPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIDWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSANIMMQRGNFRKQRKVIKCFNCGKEGHIAKNCRAPRKRGCWKCGQEGHQMKDCTERQANFLGKIWPSHKGRPGNFLQSRPEPTAPPEESFRFGEEITTPSQKQEPLDKEMYPLTSLRSLFGNDPSSQ

SEQ ID NO: 432 - protein, 497 aa, Human immunodeficiency virus
MGARASVLSGGKLDKWERIRLRPGGNKKYKLKHLVWASRELERFAVNPGLLETAEGCRQILGQLQPSLQTGSEELKSLYNTIATLYCVHQQIEVKDTKEALEKIEEEQNKSKKKAQQAVADTGNSSQVSQNYPIVQNLQGQMVHQPLSPRTLNAWVKVIEEKAFSPEVIPMFSALSEGATPQDLNTMLNTVGGHQAAMQMLKETINEEAAEWDRLHPVHAGPIAPGQMREPRGSDIAGTTSNLQEQIAWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPSHKARVLAEAMSHVTSPANVMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQELADKEQYPLASLRSLFGNDP

SEQ ID NO: 433 - protein, 502 aa, Human immunodeficiency virus
MGARASILSGGELDRWEKIRLRPGGNKKYRLKHIVWASRELERFAVNPGLLETAEGCRQILGQLQPALQTGSEELKSLFNTVATLYCVHQRIDIKDTKEALEKIEEEQNKSKKKAQQAAADTGNSSQVSQNYPIVQNMQGQMVHQPMSPRTLNAWVKVIEEKAFSPEVIPMFAALSEGATPQDLNTMLNTVGGHQAAMQMLKETINEEAAEWDRLHPVHAGPIAPGQMREPRGSDIAGTTSNLQEQIAWITSNPPIPVGDIYKRWIILGLNKIVRMYSPTSILDIKQGPKEPFRDYVDRFYKTLRAEQATQEVKNWMTETLLVQNANPDCKTILKALGPQATLEEMMTACQGVGGPGHKARVLAEAMSQVTNSANIMMQRGNFKNQRKPVKCFNCGKEGHIARNCRAPRKRGCWKCGKEGHQMKDCTERQANFLGKIWPSHKGRPGNFLQSRPEPTAPPEESFRFGEETSTPSQKQESIDRDKDMYPLTSLRSLFGNDPSSQ

SEQ ID NO: 434 - protein, 500 aa, Human immunodeficiency virus
MGARASVLSGGELDRWEKIRLRPGGKKKYKLKHIVWASRELERFAVNPGLLETSEGCRQILEQLQPALQTGSEELKSLYNTVATLYCVHQRIEIKDTKEALDKIEEEQNKSKKKAQQAAADTGNSKQVSQNYPIVQNLQGQMVHQPMSPRTLNAWVKVVEEKAFSPEVIPMFSALAEGATPQDLNTMLNTVGGHQAAMQMLKETINEEAAEWDRLHPVQAGPVAPGQMREPRGSDIAGTTSNLQEQIGWMTHNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMSQATNSTTVMMQRGKFRNQTKPVKCFNCGKEGHIARNCRAPRKKGCWKCGKEGHQMKDCTERQANFLGKIWPSYKGRPGNFLQSRPEPTAPPEESFRFGEEKTTPSQKQETIDQDLYPLASLRSLFGNDPSSQ

SEQ ID NO: 435 - protein, 500 aa, Human immunodeficiency virus
MGARASVISGGELDRWEKIRLRPGGSKKYRLKHIVWASRELERFAVNPGLLETSEGCRQILGQLQPALQTGSEELRSLYNTVATLYCVHQRIDVKDTKEALEKIEEEQNKSKKKAQQAAADTGNSSQVSQNYPIVQNLQGQMVHQPLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNSTTIMMQKGNFRNQRKTVKCFNCGKEGHIARNCRAPRKRGCWKCGKEGHQMKDCTERQANFLGKIWPSHKGRPGNFLQSRPEPTAPPEESFRFGEETATPSQKQEPIDKELYPLASLRSLFGNDPSSQ

SEQ ID NO: 436 - protein, 499 aa, Human immunodeficiency virus
MGARASVLSGGELDRWEKIRLRPGGKKKYRLKHIVWASRELERFAVNPGLLETAEGCRQILEQLQPALQTGSEELRSLFNTVATLYCVHHRIEVKDTKEALEKIEEEQNKSKKKAQQAADTGNSSKVSQNYPIVQNLQGQMVHQAMSPRTLNAWVKVVEEKAFSPEVIPMFSALSEGATPQDLNTMLNTIGGHQAAMQMLKETINEEAAEWDRLHPVQAGPIAPGQMREPRGSDIAGTTSNLQEQIGWMTHNPPIPVGEIYKRWIILGLNKIVRMYSPSSILDIKQGPKEPFRDYVDRFYKTLRAEQASQEVKNWMTETLLVQNANPDCKTILKALGPAATLEEMMTACQGVGGPSHKARVLAEAMSQMTNPATIMMQRGNFKNQRKSVKCFNCGKEGHIARNCRAPRKKGCWKCGKEGHQMKDCTERQANFLGKIWPSHKGRPGNFLQSRPEPTAPPEESFRFGEETTTPSQKQEPIDQERYPLASLRSLFGNDPSSQ

SEQ ID NO: 437 - protein, 500 aa, Human immunodeficiency virus
  variant (28)..(28): Xaa can be any naturally occurring amino acid
  variant (118)..(118): Xaa can be any naturally occurring amino acid
  variant (136)..(136): Xaa can be any naturally occurring amino acid
  variant (172)..(172): Xaa can be any naturally occurring amino acid
  variant (204)..(204): Xaa can be any naturally occurring amino acid
  variant (228)..(228): Xaa can be any naturally occurring amino acid
  variant (235)..(235): Xaa can be any naturally occurring amino acid
  variant (288)..(288): Xaa can be any naturally occurring amino acid
  variant (298)..(298): Xaa can be any naturally occurring amino acid
  variant (345)..(345): Xaa can be any naturally occurring amino acid
  variant (388)..(388): Xaa can be any naturally occurring amino acid
  variant (411)..(411): Xaa can be any naturally occurring amino acid
  variant (478)..(478): Xaa can be any naturally occurring amino acid
MGARASVLSGGELDRWERIRLRPGGKKXYRLKHVVWASRELERFAVNPGLLETSEGCKRILEQLQPSLQTGSEELKSLYNTVATLYCVHRKIDVKDTKEALEKIEEEQNKSKKRAQQXAADTGNSSQVSQNYPIVXNLQGQMVHQAMTPRTLNAWVKVVEEKAFSPEVIPMXSALSEGATPQDLNTMLNTVGGHQAAMQMLKEXINEEAAEWDRLHPVHAGPIAPGQXREPRGSXIAGTTSNLQEQIAWMTHNPPIPVGEIYKRWIILGLNKIVRMYSPSSILDIKQXPKEPFRDYVXRFYKTLRAEQASQEVKNWMTETLLVQNANPDCKTILKALGPAATLEXMMTACQGVGGPGHKARVLAEAMSQVTNSASVMMQKGNFRNQRXPIKCFNCGKEGHLARNCRAPRKXGCWKCGKEGHQMKDCTERQANFLGKIWPSHKGRPGNFLQNRPEPTAPPEESFRFGEETTTPPQKQEXIDKDLYPLASLKSLFGNDPSSQ

SEQ ID NO: 438 - protein, 500 aa, Human immunodeficiency virus
MGARASILSGGELDRWEKIRLRPGGKKKYRLKHLVWASRELERFAVNPGLLETAEGCRQIIGQLQPSLQTGSEELRSLYNTVATLYCVHQKIEVKDTKEALEKIEEEQNKSKKKAQQAAAGAGTSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMSQTTNAAAAIMMQRGNFRNQRKTVKCFNCGKEGHIAKNCRAPRKKGCWKCGQEGHQMKDCTGRQANFLGKIWPSHKGRPGNFLQSRPEPTAPPAESFRFGEETTAPPQKQEPIDKELYPLASLKSLFGSDPSSQ

SEQ ID NO: 439 - protein, 504 aa, Human immunodeficiency virus
MGARASVLSGGELDRWEKIRLRPGSKKKYQLKHIVWASRELERFAVNPGLLETSEGCRQILGQLQPSLQTGSEELKSLYNTIAVLYCVHQRIEIKDTKEALDKIEEEQNKSKKKAQQAAADTGNSSGKVSQNYPIVQNIQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPAATLEEMMTACQGVGGPSHKAKIMAEAMSQVTNSTAIMMQRGNFRNQRKIVKCFNCGKEGHIARNCRAPRKKGCWKCGKEGHQMKDCTERQANFLGKIWPSSRGRPGNFLQSRPEPTAPSAPPAESFRFGEETTTPSQKQEPTDKELYPLASLRSLFGNDPSSQ

SEQ ID NO: 440 - protein, 500 aa, Human immunodeficiency virus
MGARASVLSGGELDRWEKIRLRPMGKKKYRLKHIVWASRELERFAVNPGLLETSEGCKQILAQLQPSLQTGSEELRSLYNTVATLYCVHQKIEVKDTKEALEKVEEEQNRSKKTAQQAAAGTGNSSQASQNYPIVQNLQGQMVHQPISPRTLNAWVKVVEEKAFSPEVIPMFTALSEGATPQDLNTMLNTVGGHQAAMQMLKETINEEAAEWDRVHPVHAGPIAPGQMREPRGSDIAGTTSTLQEQIGWMTNNPPIPVGEIYKRWIVLGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIARNCRAPRKKGCWKCGKEGHQMKDCTERQANFLGKIWPSHKGRPGNFLQSRPEPTAPPEESFRFGEETTTPSQKQEPRDKELYPLASLRSLFGNDPSSQ

SEQ ID NO: 441 - protein, 501 aa, Human immunodeficiency virus
MGARASVLSGGELDRWEKIRLRPGGKKKYRLKHIVWASRELERFAVNPGLLETSEGCRQILGQLQPSLQTGSEELKSLFNTIAVLYCVHQRINIKDTKEALEKIEEEQNKSKKKTQQAAADTGNSSSQVSQNYPIVQNMQGQMVHQAISPRTLNAWVKVVEEKAFSPEVIPMFVALSEGATPQDLNTMLNTVGGHQAAMQMLKETINEEAAEWDRLHPVHAGPNPPGQMREPRGSDIAGTTSTLQEQIGWMTNNPPIPVGEIYKKWIIIGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSQVTNSTTVMMQKGNFRNQRKTIKCFNCGKEGHLARNCRAPRKKGCWKCGKEGHQMKDCTERQANFLGKIWPSHKGRPGNFLQSRPEPTAPPEESFRFGEETTTPSQKPEPIDKEVYPLTSLRSLFGNDPSSQ

SEQ ID NO: 442 - protein, 503 aa, Human immunodeficiency virus
MGARASVLSGGKLDKWERIRLRPGGKKKYKLKHLVWASRELERFAVNPGLLETPEGCRQILGQLHPSLQTGSEELKSLYNTVATLYCVHQGIEVKDTKEALEKVEEEQNRSKKKAQQAAADTGNSSRVSHNYPIVQNIQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPAATLEEMMTACQGVGGPSHKARILAEAMSQATNSAAIMMQRGNFRSQGKSVKCFNCGKIGHIAKNCRAPRKKGCWKCGKEGHQMKDCDERQANFLGKIWPSHKGRPGNFLQSRPEPSAPPEESFRFGEETTTPTTPPQKQEPIDKELYPSASLKSLFGSDPSSI

SEQ ID NO: 443 - protein, 506 aa, Human immunodeficiency virus
MGARASVLSGGQLDRWEKIRLRPGGKKRYKLKHIVWASRELERFAVNPGLLETSEGCRQIIAQLQPSLQTGSEELKSLFNTVATLYCVHQRIKVKDTKEALEKIEEEQNKSKKKVQQAAAAAAADTGNSSHVSQNYPIVQNLQGQMVHQPLSPRTLNAWVKVIEEKAFSPEVIPMFTALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPVSILDIRQGPKEPFRDYVDRFYKTLRAEQASQDVKNWMTETLLVQNANPDCKTILKALGQGATLEEMMSACQGVGGPSHKARILAEAMSQVTNPANILMQRGNFRNQRKTVKCFNCGKEGHIAKNCRAPRKKGCWKCGREGHQMKDCTERQANFLGKIWPPYKGRPGNFLQSRPEPTAPSAPPEESFRFGEETTPSQKQEQIDKELYPSASLRSLFGNDPLSQ

SEQ ID NO: 444 - protein, 503 aa, Human immunodeficiency virus
MGARASVLSGGELDRWEKIRLRPGSKKKYKLKHIVWASRELERFAVNPGLLETSEGCRQILRQLQPSLQTGSEELRSLYNTVATLYCVHQRIDVKDTKEALDKIEEEQNKCKQKVQQAAAADTGNSSNQVSQNYPIVQNMQGQMVHQAISPRTLNAWVKVVEEKAFSPEVIPMFSALSEGATPSDLNTMLNTVGGHQAAMQMLKETINEEAAEWDRLHPVQAGPVAPGQIREPRGSDIAGTTSTLQEQIAWMTHNPPIPVGDIYKRWIILGLNKIVRMYSPTSILDIKQGPKEPFRDYVDRFYKVLRAEQASQEVKNWMTETLLVQNANPDCKTILKALGPAATLEEMMTACQGVGGPGHKARVLAEAMSQVTNSTAIMMQRGNFRGPRKTVKCFNCGKEGHIAKNCRAPRKKGCWKCGKEGHQMRDCNNERQANFLGKIWPSHKERPGNFLQSRPEPTAPPEESFRFGEETATPAQKPEPIDKELYPLASLKSLFGNDPSSQ

SEQ ID NO: 445 - protein, 502 aa, Human immunodeficiency virus
MGARASVLSGGELDRWEKIRLRPGGKKKYRLKHVVWASRELERFAVNPGLLETSEGCRQILGQLHPSLQTGSEELRSLYNTIAVLYCVHQRIEVKDTKEALEKIEEEQNKSKKRAPQTAAAADTGNSSQVSQNYPIVQNLQGQMVHQAISPRTLNAWVKVVEEKAFSPEVIPMFTALSEGATPQDLNTMLNTVGGHQAAMQMLKETINEEAAEWDRLHPVHAGPNPPGQMREPRGSDIAGTTSTLQEQIGWMTSNPPIPVGEIYKRWVILGLNKIVRMYSPTSILDIKQGPKEPFRDYVDRFYKTLRAEQASQEVKNWMTETLLVQNANPDCRTILKALGPAATLEEMMTACQGVGGPGHKARVLAEAMSQATNSVNIMMQRGNLRNQRKMAKCFNCGKEGHIARNCRAPRKKGCWKCGKEGHQMKDCTERQANFLGKIWPSHKGRPGNFLQSRPEPTAPPEESFRFGEETTTPSQKPETIDKEVYPLTSLRSLFGNDPSSQ

SEQ ID NO: 446 - protein, 505 aa, Human immunodeficiency virus
MGARASVLSGGKLDTWEKIRLRPGGKKKYNLKHIVWASRELERFAVNPGLLETPEGCRQILGQLQPSLQTGSEELKSLFNTVAVLYCVHQRIDVKDTKEALDKIEEEQNKSKKQAQQAAADTGNSSGNNSQVSQNYPIVQNAQGQMVHQAITPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTHNPPIPVGEIYKRWIILGLNKIVRMYSPVSILDIKQGPKEPFRDYVDRFYKTLRAEQASQDVKNWMTETLLVQNANPDCKTILKALGPAATLEEMMTACQGVGGPGHKARVLAEAMSQVTNSSNIMMQRGNFRNQRRVVKCFNCGKEGHIAKNCRAPRKKGCWKCGREGHQMKDCTERQANFLGKIWPSHKGRPGNFLQSRPEPTALEPTAPPEESFRFGEGTATPSQEQEKLYPLTSLKSLFGNDPSSQ

SEQ ID NO: 447 - protein, 510 aa, Human immunodeficiency virus
MGARASVLSGGDLDRWEKIRLRPGGKKTYKLKHIVWASRELERFAVNPCLLETSTGCRQILGQLHPSLQTGSEELKSLYNTVATLYCVHQKIEIKDTKDALDRIEEEQNKSKKKAQQAAAADTGCSSQASSSQASQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQATNAAAVMMQKGNFRGQRKTVKCFNCGKEGHIARNCRAPRKRGCWKCGKEGHQMKDCTERQANFLGKIWPSHKGRPGNFLQNRPEPTVPTAPPAESFRFGEETATPSQKQEPIDKELYPPLASLKSLFGNDPSSQ

SEQ ID NO: 448 - protein, 500 aa, Human immunodeficiency virus
  variant (75)..(75): Xaa can be any naturally occurring amino acid
  variant (102)..(102): Xaa can be any naturally occurring amino acid
  variant (115)..(115): Xaa can be any naturally occurring amino acid
  variant (124)..(124): Xaa can be any naturally occurring amino acid
  variant (136)..(136): Xaa can be any naturally occurring amino acid
  variant (138)..(138): Xaa can be any naturally occurring amino acid
  variant (151)..(151): Xaa can be any naturally occurring amino acid
  variant (215)..(215): Xaa can be any naturally occurring amino acid
  variant (248)..(248): Xaa can be any naturally occurring amino acid
  variant (312)..(312): Xaa can be any naturally occurring amino acid
  variant (333)..(333): Xaa can be any naturally occurring amino acid
  variant (336)..(336): Xaa can be any naturally occurring amino acid
  variant (344)..(344): Xaa can be any naturally occurring amino acid
  variant (370)..(370): Xaa can be any naturally occurring amino acid
  variant (374)..(374): Xaa can be any naturally occurring amino acid
  variant (443)..(443): Xaa can be any naturally occurring amino acid
  variant (448)..(448): Xaa can be any naturally occurring amino acid
  variant (463)..(463): Xaa can be any naturally occurring amino acid
MGARASVLSGGELDRWEKIRLRPGGRKKYQLKHLVWASRELERFAVNPGLLETSSGCRQILRQLQPALETGSEEXKSLYNTVATLYCVHQRIEVKDTKEALXKIEEEQNKCKEKXQQAAAATGXSSQVSQNYPIVXNXQGQMVHQAISPRXLNAWVKVVEEKAFSPEVIPMFSALSEGATPQDLNTMLNTVGGHQAAMQMLKETINEEAAEWDRXHPVHAGPIAPGQMREPRGSDIAGTTSTLQEQIXWMTHNPPIPVGDIYKRWIIIGLNKIVRMYSPTSILDIRQGPKEPFRDYVDRFYKTLRAEQATQXVKNWMTETLLVQNANPDCKTXLKXLGPAATLXEMMTACQGVGGPGHKARVLAEAMSQXTNSXNIMMQRGNFRNPRKSVKCFNCGKEGHIAKNCKAPRKKGCWKCGKEGHQMKDCTERQANFLGKIWPSHKXRPGNXLQSRPEPTAPPEESXRFGEETATPSQKQGTIDKELYPLTSLRSLFGNDPSSQ

SEQ ID NO: 449 - protein, 502 aa, Human immunodeficiency virus
  variant (114)..(114): Xaa can be any naturally occurring amino acid
  variant (132)..(132): Xaa can be any naturally occurring amino acid
  variant (170)..(170): Xaa can be any naturally occurring amino acid
  variant (190)..(190): Xaa can be any naturally occurring amino acid
  variant (263)..(263): Xaa can be any naturally occurring amino acid
  variant (273)..(273): Xaa can be any naturally occurring amino acid
  variant (280)..(280): Xaa can be any naturally occurring amino acid
  variant (299)..(299): Xaa can be any naturally occurring amino acid
  variant (314)..(314): Xaa can be any naturally occurring amino acid
  variant (391)..(391): Xaa can be any naturally occurring amino acid
  variant (401)..(401): Xaa can be any naturally occurring amino acid
  variant (445)..(445): Xaa can be any naturally occurring amino acid
  variant (497)..(497): Xaa can be any naturally occurring amino acid
MGARASVFSGGELDKWEKIQLRPGGKKRYKLKHLVWASRELERFAVNPGLLETSEGCKQILEQLQPSLQTGSEELKSLYNTVATIYCVHKRIDVRDTKEALDKIEEEQNKSKKXAQQAAAAAAGPGNSQVSXNYPIVQNIQGQMVHQAISPRTLNAWVKVVEEKAFSPEXIPMFSALSEGATPQDLNTMXNTVGGHQAAMQMLKETINEEAAEWDRLHPVHAGPIAPGQMREPRGSDIAGTTSTLQEQINWMTNNPPIPVGEXYKRWIILGLXKIVRMYXPASILDIRQGPKEPFRDYXDRFYKTLRAEQASQXVKNWMTETLLVQNANPDCKTILKALGPAATLEEMMTACQGVGGPGHKARVLAEAMSQVTNSATIMMQKGNFRNQRKXVKCFNCGKEXHIARNCRAPRKKGCWKCGREGHQMKDCTERQANFLGKIWPSHKXRPGNFLQSRPEPTAPPEESFRFGEETTTPPQKQGPMDKELYPLASLRSLFGXDPSSQ

SEQ ID NO: 450 - protein, 508 aa, Human immunodeficiency virus
  variant (109)..(109): Xaa can be any naturally occurring amino acid
  variant (228)..(228): Xaa can be any naturally occurring amino acid
  variant (326)..(326): Xaa can be any naturally occurring amino acid
  variant (330)..(330): Xaa can be any naturally occurring amino acid
  variant (384)..(384): Xaa can be any naturally occurring amino acid
  variant (398)..(398): Xaa can be any naturally occurring amino acid
  variant (405)..(405): Xaa can be any naturally occurring amino acid
  variant (409)..(409): Xaa can be any naturally occurring amino acid
  variant (423)..(423): Xaa can be any naturally occurring amino acid
  variant (478)..(478): Xaa can be any naturally occurring amino acid
MGARASVLSGGKLDKWEKIRLRPGGKKKYKLKHLVWASRELERFAVNPGLLETPEGCRQILGQLQPSLQTGSEELKSLFNTVATLYCVHQMIEIRDTKEALEKIEEEQXQSKKKAQQATADAGKTSQVSQNYPIVQNIQGQMVHQPLSPRTLNAWVKVVEEKAFSPEVIPMFSALSEGATPQDLNTMLNTVGGHQAAMQMLKETINEEAGEWDRLHPVQAGPVAPGQXREPRGSDIAGTTSTLQEQIAWMTHNPPIPVGDIYKRWIILGLNKIVRMYSPTSILDIRQGPKEPFRDYVDRFYKTLRAEQASQEVKNWMTETLLVQNXNPDXKTILKALGPAATLEEMMTACQGVGGPGHKARVLAEAMSQVTNSATIMMQKGNYXNQGKMVKCFNCGKXGHIARNXRAPXKKGCWKCGKEGHQXKDCTERQANFLGKIWPSHKGRPGNFLQNRPEPAAPQNRTEPTAPPEESFRFGEEXITPSQKQEPIDREYPLASLRSLFGNDPSSQ

SEQ ID NO: 451 - protein, 507 aa, Human immunodeficiency virus
MGARASVLSGGKLDQWEKIYLRPGGKKKYKLKHLVWASRELERFAVNPGLLETSEGCRRILGQLQPSLQTGSEELKSLYNTIATLYCVHQRIDVKDTKEALDKIEEEQNKIKKKTQQAAADTGNSSQVSQNYPIVQNLQGQMVHQPISARTLNAWVKVVEEKAFSPEVIPMFTALSEGATPQDLNTMLNTVGGHQAAMQMLKETINEEAAEWDRLHPAQAGPVAPGQMRDPRGSDIAGTTSTLQEQIGWMTSNPPVPVGEIYKRWIILGLNKIVRMYSPTSILDIKQGPKEPFRDYVDRFYKTLRAEQASQDVKNWMTETLLVQNANPDCKTILKALGPAASLEEMMTACQGVGGPSHKARVLAEAMSHVTNSNAIMMQRGNFKNQRKTVKCFNCGKEGHIARNCRAPRKKGCWKCGREGHQMKDCTERQANFLGKIWPSHKGRPGNFLQSRPEPTAPPAEPTAPPEESFRFGEGATAPPQKQEPIDKEMYPLVSLRSLFGSDPSSQ

SEQ ID NO: 452 - protein, 497 aa, Human immunodeficiency virus
  variant (21)..(21): Xaa can be any naturally occurring amino acid
  variant (52)..(52): Xaa can be any naturally occurring amino acid
  variant (114)..(114): Xaa can be any naturally occurring amino acid
  variant (134)..(134): Xaa can be any naturally occurring amino acid
  variant (136)..(136): Xaa can be any naturally occurring amino acid
  variant (138)..(138): Xaa can be any naturally occurring amino acid
  variant (143)..(143): Xaa can be any naturally occurring amino acid
  variant (146)..(146): Xaa can be any naturally occurring amino acid
  variant (216)..(216): Xaa can be any naturally occurring amino acid
  variant (227)..(227): Xaa can be any naturally occurring amino acid
  variant (298)..(298): Xaa can be any naturally occurring amino acid
  variant (307)..(307): Xaa can be any naturally occurring amino acid
  variant (342)..(342): Xaa can be any naturally occurring amino acid
  variant (402)..(402): Xaa can be any naturally occurring amino acid
  variant (444)..(444): Xaa can be any naturally occurring amino acid
  variant (452)..(452): Xaa can be any naturally occurring amino acid
  variant (480)..(480): Xaa can be any naturally occurring amino acid
MGARASILSGGELDRWEKIRXRPGGKKQYRLKHLVWASRELERFAINPGLLXTSEGCRQILRHLHSSLQAGSEELKSLYNTVATLYCVHQRIDIKDTKEALDKIEEEQNKSKKXAQQAAADTGNSSQVSQNYPXVXNXQGQMXYQXLSPRTLNAWVKVVEEKAFSPEVIPMFSALSEGATPGDLNTMLNTVGGHQAAMQMLKETINEEAAEWDRLXPVQAGPIAPGXMREPRGSDIAGTTSTLQEQIGWMTSNPPIPVGEIYKRWIILGLNKIVRMYSPTSILDIKQGPKEPFRDYVXRFYKTLRAXQASQEVKNWMTETLLVQNANPDCKAILRALGPAAXLEEMMTACQGVGGPSHKARVLAEAMSQVTNQATIMMQKGNFRNQRKTVKCFNCGKEGHIXRNCRAPRKKGCWKCGKEGHQMKDCTERQANFLGKIWPSHKGXPGNFPQSXTEPTAPPEESFRFGEETTVPSQKQELIXKNLYPSASLRSLFGNDP

SEQ ID NO: 453 - protein, 502 aa, Human immunodeficiency virus
MGARASVLSGGRLDQWEKIRLRPGGKKKYKLKHIVWASRELERFAVNPGLLETSDGCRKILGQLQPSLQTGSEELKSLYNTIAVLYCVHQGTQVKDTKEALDKIEEEQNKSKKKAQQAAAAADAGNNSPVSQNFPIVQNLQGQMVHQAISPRTLNAWVKVIEEKAFSPEVIPMFSALAEGATPQDLNTMLNTVGGHQAAMQMLKETINEEAAEWDRLHPVHAGPVAPGQMREPRGSDIAGTTSTLQEQIGWMTHNPPIPVGEIYKRWIIMGLNKIVRMYSPVSILDIRQGPKEPFRDYVDRFYKTLRAEQASQEVKNWMTETLLVQNANPDCKTILKALGPAATLEEMMTACQGVGGPSHKARILAEAMSQVTNPTNILMQRGNFKNQRRSVKCFNCGKEGHIARNCRAPRKKGCWKCGKEGHQMKDCTERQANFLGKIWPSHKGRPGNFLQSRPEPTAPPEESFRFGEETTTPSQKQEKIDKEMYPLTSLKSLFGNDPSSQ

SEQ ID NO: 454 - protein, 503 aa, Human immunodeficiency virus
  variant (15)..(15): Xaa can be any naturally occurring amino acid
  variant (49)..(49): Xaa can be any naturally occurring amino acid
  variant (98)..(98): Xaa can be any naturally occurring amino acid
  variant (113)..(113): Xaa can be any naturally occurring amino acid
  variant (115)..(115): Xaa can be any naturally occurring amino acid
  variant (137)..(137): Xaa can be any naturally occurring amino acid
  variant (143)..(143): Xaa can be any naturally occurring amino acid
  variant (166)..(166): Xaa can be any naturally occurring amino acid
  variant (184)..(184): Xaa can be any naturally occurring amino acid
  variant (188)..(188): Xaa can be any naturally occurring amino acid
  variant (290)..(290): Xaa can be any naturally occurring amino acid
  variant (378)..(378): Xaa can be any naturally occurring amino acid
  variant (387)..(387): Xaa can be any naturally occurring amino acid
  variant (390)..(390): Xaa can be any naturally occurring amino acid
  variant (392)..(392): Xaa can be any naturally occurring amino acid
  variant (420)..(420): Xaa can be any naturally occurring amino acid
  variant (449)..(449): Xaa can be any naturally occurring amino acid
MGARASVLSGGQLDXWEKIRLRPGGKKKYQLKHIVWASKELEHFALNPXLLETTEGCRQILGQLQPALRTGTQELKSLYNTVAVLYCVHQRIDIKDTXEALEKIEEEQNKSKXKXQQAAADTGKDNPVSQNYPIVQXAQGQMXHQPISPRTLNAWVKVVEEKAFSXEVIPMFAALSEGATPQDXNTMXNTVGGHQAAMQMLKETINEEAAEWDRLHPVHAGPIAPGQMREPRGSDIAGTTSTLQEQIAWMTNNPPIPVGEIYKKWIIIGLHKIVRMYSPTSILDIKQGPXEPFRDYVDRFYKTLRAEQASQEVKNWMTETLLVQNANPDCKTILKALGPAATLEEMMTACQGVGGPSHKARVLAEAMSQVTNSASANXMMQKGNFRXQRXIXKCFNCGKEGHIARNCKAPRRKGCWKCGXEGHQLKDCTERQANFLGKIWPSHKGRPGXFPQSRLEPTAPPEESFRFGEETATPSQKQESRDKEELYPLASLRSLFGNDPSSQ

SEQ ID NO: 455 - protein, 500 aa, Human immunodeficiency virus
  variant (114)..(114): Xaa can be any naturally occurring amino acid
  variant (152)..(152): Xaa can be any naturally occurring amino acid
  variant (245)..(245): Xaa can be any naturally occurring amino acid
  variant (350)..(350): Xaa can be any naturally occurring amino acid
  variant (369)..(369): Xaa can be any naturally occurring amino acid
  variant (427)..(427): Xaa can be any naturally occurring amino acid
  variant (461)..(461): Xaa can be any naturally occurring amino acid
MGARASVLSGGKLDKWEKIQLRPGGKKRYQLKHIVWASRELERFAVNPGLLETSEGCRKILVQLQPSLQTGSEELKSLYNTVATLYCVHQGVDVRDTKEALDKIEEEQNKSKKXAQAAAADTGNNSQVSQNYPIVQNIQGQMVHQAISPRTXNAWVKVVEEKAFSPEIIPMFTALSEGATPQDLNTMLNTVGGHQAAMQMLKETINEEAAEWDRLHPVQAGPVAPGQVREPRGSDIAGTTSTLQXQIAWMTHNPPIPVGEIYKRWIILGLNKIVRMYSPTSILDIKQGPKESFRDYVDRFYKTLRAEQASQEVKNWMTETLLVQNANPDCKTILKALGPAATLEEMMTAXQGVGGPGHKARVLAEAMSXFTNPANIMMQRGNFKNQRKTVKCFNCGKEGHIARNCRAPRKKGCWKCGKEGHQMKDCXERQANFLGKIWPSHKGRPGNFLQSRPEPSAPPEXSFRFGEETATPSQKQEPIDKELYPSASLRSLFGNDPSSQ

SEQ ID NO: 456 - protein, 500 aa, Human immunodeficiency virus
MGARASVLSGGKLDKWEKIRLRPGGRKKYKLKHLVWASRELERFAVDPGLLETSEGCRQILGQLQPALKTGSEEFRSLYNTVATLYCVHQNIEVKDTKEALEKIEEEQNKSKKKAQQAAAGTGNSSQVSQNYPIVQNLQGQMVHQAISPRTLNAWVKVVEEKAFSPEVIPMFSALSEGATPQDLNTMLNTVGGHQAAMQMLKDTINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCRTILKALGPAATLEEMMTACQGVGGPGHKARVLAEAMSQMTNQATIMVQRGNFRNQGRNIKCFNCGKEGHIARNCRAPRKKGCWKCGKEGHQMKECTERQANFLGKIWPSHKGRPGNFLQSRPEPTAPPEESFRFGEETTTPSQKQEPIDKNLYPLTSLKSLFGNDPSSQ

SEQ ID NO: 457 - protein, 502 aa, Human immunodeficiency virus
MGARASVLSGGKLDSWERIRLRPGGKKKYRLKHIVWASRELERFAVNPGLLETAEGCRQILGQLQPALQTGSEELRSLYNTIATLYCVHQRIEVKDTKEALDKIEEEQNKSKKKAQQAADAGTSSQVSQNYPIVQNIQGQMVHQPISPRTLNAWVKVVEEKAFSPEVIPMFSALSEGATPQDLNTMLNTVGGHQAAMQMLKETINEEAADWDRLHPVHAGPIAPGQMREPRGSDIAGTTSTLQEQIGWMTNNPPIPVGEIYKRWIILGLNKIVRMYSPASILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKAVKCFNCGKEGHVARNCRAPRKRGCWKCGKEGHQMKDCTERQANFLGKIWPSHKGRPGNFPQSRLMPTAPPAPPEESFRFGEEATTPSQRQEPIDKEHYPLTSLRSLFGNDPSSQ

SEQ ID NO: 458 - protein, 507 aa, Human immunodeficiency virus
MGARASVLSGGELDRWEKIRLRPGGSKRYKLKHIVWASRELERFAVNPGLLETSEGCRQILRQLQPSLQTGSEELKSLFNTVATIYCVHQRIDVKDTKEALDKIEEEQNKSKEQNKSKEKAQQAAAGTGNSSQVSSQNYPIVQNLQGQMVHQAISPRTLNAWVKVVEEKAFSPEVIPMFSALSEGATPSDLNTMLNTVGGHQAAMQMLKETINEEAAEWDRLHPVHAGPVAPGQMREPRGSDIAGTTSTLQEQIAWMTSNPPIPVGDIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSANIMMQRGNFRNQRKTVKCFNCGKEGHIARNCRAPRKKGCWKCGKEGHQMKDCTERQANFLGKIWPSHKGRPGNFLQSRPEPTAPPEESFRFGEETTTPSQKQDPIDKDLYPLASLRSLFGNDPSSQ

SEQ ID NO: 459 - protein, 505 aa, Human immunodeficiency virus
  variant (28)..(28): Xaa can be any naturally occurring amino acid
  variant (113)..(113): Xaa can be any naturally occurring amino acid
  variant (115)..(115): Xaa can be any naturally occurring amino acid
  variant (151)..(151): Xaa can be any naturally occurring amino acid
  variant (156)..(156): Xaa can be any naturally occurring amino acid
  variant (238)..(238): Xaa can be any naturally occurring amino acid
  variant (271)..(271): Xaa can be any naturally occurring amino acid
  variant (274)..(274): Xaa can be any naturally occurring amino acid
  variant (282)..(282): Xaa can be any naturally occurring amino acid
  variant (306)..(306): Xaa can be any naturally occurring amino acid
  variant (309)..(309): Xaa can be any naturally occurring amino acid
  variant (314)..(314): Xaa can be any naturally occurring amino acid
  variant (325)..(325): Xaa can be any naturally occurring amino acid
  variant (340)..(340): Xaa can be any naturally occurring amino acid
  variant (347)..(347): Xaa can be any naturally occurring amino acid
  variant (480)..(480): Xaa can be any naturally occurring amino acid
MGARASILSGGQLDRWEKIRLRPGGKKXYQLKHIVWASRELERFAVNPGLLETAEGCRQILGQLQPSLQTGSEELKSLFNTVAVLFCVHQRIDVKDTKEALDKIEEEQNKSKXKXQQAAADTGNTGNSNQVSQNYPIVQNLQGQMVHQAIXPRTLXAWVKVVEEKAFSPEVIPMFSALSEGATPQDLNTMLNTVGGHQAAMQMLKETINEEAAEWDRLHPVHAGPIAPGQMREPRGSXIAGTTSTLQEQIGWMTNNPPIPVGEIYKRWIIXGLXKIVRMYSXTSILDIKQGPKEPFRDYVDRFYKXLRXEQASXEVKNWMTETLXVQNANPDCKTILKAXGPAATLXEMMTACQGVGGPGHKARVLAEAMSQVHPVNIMMQRGNFKNQRKTIKCFNCGKEGHLARNCRAPRKKGCWKCGKEGHQMKDCTERQANFLGKIWPSHKGRPGNFLQSRPEPTAPPAPPEESFRFGEETTTPPQXQEPIDKELYPLASLKSLFGNDPLSQ

SEQ ID NO: 460 - protein, 500 aa, Human immunodeficiency virus
  variant (53)..(53): Xaa can be any naturally occurring amino acid
  variant (224)..(224): Xaa can be any naturally occurring amino acid
MGARASILRGEKLDKWEKIQLRPGGKKRYQLKHLIWASRELERFAVNPGLLEXSAGCRQILGQLQSSLQTGTEELRSLFNTVAVLYCVHQRIEIRDTKEALDKVEEEQNKGKVKTQQAAADTGSSSKVSQNYPIVQNLQGQMVHQPLTPRTLNAWVKVVEEKAFSPEVIPMFTALSEGATPQDLNTMLNTVGGHQAAMQMLKETINEEAAEWDRVHPVHAGPIXPGQMREPRGSDIAGTTSTLQEQIGWMTSNPPIPVGEIYKRWIILGLNKIVRMYSPTSILDIKQGPKEPFRDYVDRFYKTLRAEQASQDVKNWMTETLLVQNANPDCKIILKSLGPGASLEEMMTACQGVGGPSHKARVLAEAMSQVTNSNTIMMQRGNFRNQRKTVKCFNCGKEGHIARNCRAPRKKGCWKCGNEGHQMKDCTERQANFLGKIWPSHKGRPGNFLQSRPEPSAPPEESFRFGEETTPPSQKQEQTDKELYPLASLRSLFGNDPSSQ

SEQ ID NO: 461 - protein, 502 aa, Human immunodeficiency virus
  variant (226)..(226): Xaa can be any naturally occurring amino acid
  variant (444)..(444): Xaa can be any naturally occurring amino acid
MGARASVLSGGELDKWEKIRLRPGGKKKYKLKHIVWAGRELERYAVNPGLLETSGGCRQIMEQLQPALQTGSEELKSLYNTVATLYCVHQKIEIRDTKEALDKIEEEQNKSKKKAQQAAAAADTGNSSKVSQNYPIVQNFQGQMVHQAISPRTLNAWVKVIEEKAFSPEVIPMFTALSEGATPQDLNTMLNTVGGHQAAMQMLKETINEEAAEWDRLHPAQAGPVXPGQIRDPRGSDIAGTTSTLQEQIDWMTRNPPVPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQKKNVKCFNCGKEGHIARNCRAPRKKGCWKCGREGHQMKDCTERQANFLGKIWPSHXGRPGNFLQSRPEPTAPPEESFRFGEGTTTPPQKQETIDKDLYPLASLKSLFGNDPLSQ

SEQ ID NO: 462 - protein, 500 aa, Human immunodeficiency virus
  variant (68)..(68): Xaa can be any naturally occurring amino acid
  variant (227)..(227): Xaa can be any naturally occurring amino acid
  variant (230)..(230): Xaa can be any naturally occurring amino acid
  variant (307)..(307): Xaa can be any naturally occurring amino acid
  variant (460)..(460): Xaa can be any naturally occurring amino acid
  variant (474)..(474): Xaa can be any naturally occurring amino acid
MGARASVLSGGELDRWEKIRLRPGGKKKYRLKHIVWASRELERFAVNPGLLETSEGCRQILRQLQPAXQTGSEELKSLYNTVATLYCVHQRIEVKDTKEALEKIEEEQDKSKKKAQQAAADTGNSSQVSQNYPIVQNLQGQMVHQAISPRTLNAWVKVVEEKAFSPEVIPMFTALSEGATPQDLNTMLNTVGGHQAAMQMLKETINEEAAEWDRLHPVQAGPVAPGXMRXPRGSDIAGTTSTLQEQIGWMTSNPPIPVGEIYKRWIILGLNKIVRMYSPASILDIRQGPKEPFRDYVDRFYKTLRAXQASQEVKNWMTETLLVQNANPDCKTILKALGPAATLEEMMTACQGVGGPGHKARVLAEAMSQVTNSATIMMQKGNFRNQRKVVKCFNCGKEGHIARNCRAPRKRGCWKCGKEGHQMKDCTERQANFLGKIWPSHKGRPGNFLQSRPEPTAPPXESFRFGEETATPPXKQEPIDKELYPLASLRSLFGNDPSSP

SEQ ID NO: 463 - protein, 504 aa, Human immunodeficiency virus
  variant (143)..(143): Xaa can be any naturally occurring amino acid
  variant (404)..(404): Xaa can be any naturally occurring amino acid
  variant (442)..(442): Xaa can be any naturally occurring amino acid
  variant (471)..(471): Xaa can be any naturally occurring amino acid
  variant (474)..(474): Xaa can be any naturally occurring amino acid
  variant (477)..(477): Xaa can be any naturally occurring amino acid
  variant (481)..(481): Xaa can be any naturally occurring amino acid
MGARASVLSGGDLDRWEKIRLRPGGKKQYKLKHIVWASRELERFAVNPGLLETAEGCRKILEQLQPSLQTGSEELKSLHNTVAVLYCVHQRIEVKDTKEALDKIEEERNKSKKKAQQPAADTGSHNQVSQNYPIVQNMQGQMXHQPISPRTLNAWVKVVEEKAFNPEVIPMFSALSEGATPQDLNTMLNTVGGHQAAMQMLKETINEEAAEWDRMHPVHAGPVAPGQMREPRGSDIAGTTSTLQEQIGWMTSNPPVPVGEIYKRWIILGLNKIVRMYSPISILDIRQGPKEPFREYVDRFYKTLRAEQASQDVKNWMTETLLVQNANPDCKTILKALGPGATLEEMMTACQGVGGPAHKARVLAEAMSQVTQPAAVMMQRGNFKNQKRIVKCYNCGKEGHIAKXCRAPRKKGCWKCGGEGHQMKDCTERQANFLGKFWPSHXGRPGNFLQNSPEPTAPPAPPEESFRFGEXIAXPSXKQEXKGKELYPPLASLRSLFGNDPSSQ

SEQ ID NO: 464 - protein, 500 aa, Human immunodeficiency virus
MGARASVLSGGDLDRWEKIRLRPGGKKKYQLKHIVWASRELERFAVNPGLLETSEGCRQILGQLQPSLQTGSEELKSLFNTIATLYCVHQKIDVKDTKEALEKIEEEQNKSKKKAQQATADTGNSSQVSRNYPIVQNIQGQMVHQPLSPRTLNAWVKVVEEKSFSPEVIPMFSALSEGATPQDLNTMLNTIGGHQAAMQMLKETINEEAAEWDRLHPVHAGPIAPGQMREPRGSDIAGTTSNLQEQIAWMTNNPPIPVGEIYKRWIILGLHKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSTTIMMQKGNFRNHRKIVKCFNCGKEGHIAKNCRAPRKRGCWKCGKEGHQMKDCTERQANFLGKIWPSYKGRPGNFLQSRPEPTAPPEESFRFGEETTTPSQKQDLIDKELHPLASLKSLFGNDPSSQ

SEQ ID NO: 465 - protein, 500 aa, Human immunodeficiency virus
  variant (17)..(17): Xaa can be any naturally occurring amino acid
  variant (66)..(66): Xaa can be any naturally occurring amino acid
  variant (82)..(82): Xaa can be any naturally occurring amino acid
  variant (88)..(88): Xaa can be any naturally occurring amino acid
  variant (167)..(167): Xaa can be any naturally occurring amino acid
  variant (175)..(175): Xaa can be any naturally occurring amino acid
  variant (211)..(211): Xaa can be any naturally occurring amino acid
  variant (406)..(406): Xaa can be any naturally occurring amino acid
  variant (408)..(408): Xaa can be any naturally occurring amino acid
  variant (452)..(452): Xaa can be any naturally occurring amino acid
  variant (471)..(471): Xaa can be any naturally occurring amino acid
MGARASVLSGGKLDKWXKIRLRPGGRKKYQLKHIVWASRELERFAVNPGLLETAEGCRQILGQLQXSLQTGSEELKSLYNTXAVLYCXHQNIEVKDTKEALDQIEEEQNKSKKKAQQAAASTGNSGQISQNYPIVQNLQGQMVHQAISPRTLNAWVKVVEEKAFSPXVIPMFTAXSEGATPQDLNTMLNTVGGHQAAMQMLKETINEEAAXWDRIHPVHAGPIAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNSNPDCRTILKALGPAATLEEMMTACQGVGGPGHKARVLAEAMSQATNQASIMMQRGNFRNQRKSVKCFNCGKEGHIAKNCXAXRRKGCWKCGKEGHQMKDCTERQANFLGKIWPSHKGRPGNFLQSXPEPTAPPEESFRFGGETTXPSQKQEQTKEELYPLTSLKSLFGNDPSSQ

SEQ ID NO: 466 - protein, 501 aa, Human immunodeficiency virus
MGARASVLSGGELDKWEKIRLRPGGKKKYKLKHIVWASRELERFAVNPSLLETAAGCRQILAQLQPSLQTGSEELKSLHNTIATLYCVHQRIDVKDTKEALDRIEEEQNKSKKKAQQAAADTGNNSSQVSQNYPIVQNMQGQMVHQAISPRTLNAWVKVIEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNANTIMMQRGNFRNQRKTVKCFNCGKEGHIAKNCRAPRKKGCWKCGREGHQMKDCTERQANFLGKIWPSHKGRPGNFLQSRPEPSAPPAESFRFGEETTTPPQKQEPIDKELYPLASLKSLFGSDPLSQ

SEQ ID NO: 467 - protein, 502 aa, Human immunodeficiency virus
  variant (38)..(38): Xaa can be any naturally occurring amino acid
  variant (462)..(462): Xaa can be any naturally occurring amino acid
  variant (467)..(467): Xaa can be any naturally occurring amino acid
MGARASVLSAGELDKWEKIRLRPGGKKKYRLKHIVWAXRELERFAVNPGLLETSEGCRQILGQLQPSLQTGSEELRSLFNTIATLYCVHQKIEVKDTKEALEKVEEEQNKSKKKAQQAAAGTGNSSQTSQNFPIVQNLQGQMVHNPLSPRTLNAWVKVIEDKAFSPEVIPMFTALSEGATPQDLNTMLNTVGGHQAAMQMLKETINEEAAEWDRLHPVQAGPIAPGQIREPRGSDIAGTTSNLQEQITWMTGNPPIPVGDIYKRWIIIGLNKIVRMYSPVSILDIRQGPKEPFRDYVDRFYKTLRAEQASQDVKNWMTETLLVQNANPDCKTILKALGPGASLEEMMTACQGVGGPAHKARVLAEAMSQANSTTIMMQRGNFRGQRKIIKCFNCGKEGHIAKNCRAPRKKGCWRCGKEGHQMKDCTERQANFLGKIWPSHKGRPGNFLQSRPEPTAPPAPPXESFRXGEGTTTPSQKQETIDKELYPLASLKSLFGNDPSSQ

SEQ ID NO: 468 - protein, 508 aa, Human immunodeficiency virus
  variant (79)..(79): Xaa can be any naturally occurring amino acid
  variant (115)..(115): Xaa can be any naturally occurring amino acid
  variant (179)..(179): Xaa can be any naturally occurring amino acid
  variant (189)..(189): Xaa can be any naturally occurring amino acid
  variant (202)..(202): Xaa can be any naturally occurring amino acid
  variant (292)..(292): Xaa can be any naturally occurring amino acid
  variant (297)..(297): Xaa can be any naturally occurring amino acid
  variant (342)..(342): Xaa can be any naturally occurring amino acid
  variant (395)..(395): Xaa can be any naturally occurring amino acid
MGARASVLSGEKLDRWEKIRLRPGGKKQYKLKHIVWASRELERFAVNPGLLETSEGCRQILGQLQPSLQTGSEELKSLXNTVATLYCVHQRIEVKDTKEALDKIEEEQNKSKKKXQQAAADTGNSTGNSSSQVSQNYPIVQNLQGQMVHQALSPRTLNAWVKVVEEKAFSPEVIPMFTXLSEGATPQDXNTMLNTVGGHQAXMQMLKETINEEAAEWDRLHPVHAGPVAPGQMREPRGSDIAGTTSTLQEQIGWMTNNPPIPVGEIYKRWIILGLNKIVRMYSPTSILDIKXGPKEXFRDYVDRFYKTLRAEQASQEVKNWMTETLLVQNANPDCKTILKAXGPAATLEEMMTACQGVGGPGHKARVLAEAMSQATNSAAAIMMQRGKFKNQRKXVKCFNCGKEGHIARNCRAPRKKGCWKCGKEGHQMKDCTERQANFLGKIWPSHKGRPGNFLQSRPEPTAPTAPPEESFRFGEETTAPSQKQEPIDKEVYPLASLKSLFGNDPSS

SEQ ID NO: 469 - protein, 499 aa, Human immunodeficiency virus
  variant (39)..(39): Xaa can be any naturally occurring amino acid
  variant (43)..(43): Xaa can be any naturally occurring amino acid
  variant (182)..(182): Xaa can be any naturally occurring amino acid
  variant (193)..(193): Xaa can be any naturally occurring amino acid
  variant (231)..(231): Xaa can be any naturally occurring amino acid
MGARASVLSGGELDKWEKIRLRPGGKKKYQLKHIVWASXELEXFAVNPGLLETAAGCRQILGQLHPSLQTGSEELKSLYNTVATLYCVHQKIEVRDTKEALDKVEEEQNKSKKKAQQAADTGNSSQVSQNYPIVQNLQGQMVHQPISPRTLNAWVKVVEEKAFSPEVIPMFSALSEGATPQXLNTMLNTVGGXQAAMQMLKETINEEAAEWDRLHPPQAGPIAPGQIREPXGSDIAGSTSNLQEQVRWMTSNPPIPVGEIYKRWIILGLNKIVRMYSPTSILDIKQGPKEPFRDYVDRFYRTLRAEQASQEVKNWMTETLLVQNANPDCKTILKALGPAATLEEMMTACQGVGGPAHKARVLAEAMSHVTGANAIMMQKGNFKSQRKTVKCFNCGKEGHIAKNCRAPRKKGCWKCGREGHQMKDCTERQANFLGKIWPSHKGRPGNFLQSRPEPTAPPEESFRFGEEAAAPPQKQEPIDKELYPLASLKSLFGNDPSSQ

SEQ ID NO: 470 - protein, 500 aa, Human immunodeficiency virus
MGARASVLSAGELDKWEKIRLRPGGKKKYRLKHIVWASRELERFAVNPGLLETAEGCKQILGQLQSSLQTGSEELKSLFNLVAVLWCVHQKIDVKDTKEALDKIEEEKNKSKKKAQQAAADTGNSNQVSQNYPIVQNLQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIGWMTSNPPIQVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQVTNSPAIMMQRGNFRNQRKTVKCFNCGKEGHIAKNCRAPRKKGCWKCGREGHQMKDCTERQANFLGKIWPSHKGRPGNFPQSKIEPTAPPEESFRFGEETTTPPQKQEPIDKELYPLASLRSLFGNDPSSQ

SEQ ID NO: 471 - protein, 508 aa, Human immunodeficiency virus
MGARASVLSGGQLDKWEKIRLRPGGKKKYQLKHLVWASRELERFAVNPGLLETAGGCRQILGQLHPSLQTGSEELRSLYNTIATLYCVHQNIEVKDTKEALEKIEEEQNKSKKKAQQAAADTANSSQVSQVSQNYPIVQNLQGQMVHQAISPRTLNAWVKVIEEKAFSPEVIPMFSALSEGATPQDLNTMLNTVGGHQAAMQMLKETINEEAAEWDRLHPAQAGPVAPGQIRDPRGSDIAGTTSNLQEQITWMTSNPPIPVGEIYKRWIILGLNKIVRMYSPVSILDIRQGPKEPFRDYVDRFYKTLRAEQASQEVKGWMTETLLVQNANPDCKTILKALGPAATLEEMMTACQGVGGPSHKARILAEAMSQVTSSATIMMQRGNFRNQRKTIKCFNCGKEGHLAKNCRAPRKRGCWKCGKEGHQMKDCNERQANFLGRIWPSSKGRPGNFLQSRPEPTAPPEESFRFGEETTTPSQKQELIDKEPIDKETYPLASLRSLFGNDPLSQ

SEQ ID NO: 472 - protein, 512 aa, Human immunodeficiency virus
MGARASVLSGGELDRWEKIRLRPGGKKRYKLKHIVWASRELERFAVNPSLLETSEGCRQILRQLQPSLQTGSEEIKSLYNTVATLYCVHQRIDVKDTKEALDKIEEEQNKSKKKAQPAAAADTENSSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTSPANIMMQRGNFRNQRKIIKCFNCGKEGHIAKNCRAPRKKGCWKCGKEGHQMKECTERQANFLGKIWPSHKGRPGNFLQSRPEPTAPPAQSRPEPTAPPAESFRFGEETATPSQKQETVDKEVYPLASLKSLFGSDPLLQ

SEQ ID NO: 473 - protein, 500 aa, Human immunodeficiency virus
MGARASVLRGGQLDTWEKIRLRPGGKKQYRLKHLVWASRELERFAINPGLLETAEGCRQIIGQLQPALQTGSEEVKSLFNTVATLYCVHQNIEVRDTKEALDKIEEEQNKSKKKAQQAAADTGNSSQVSQNYPIVQNLQGQMVHQAITPRTLNAWVKVVEEKAFSPEVIPMFSALSEGCTPQDLNLMLNTVGGHQAAMQMLKETINEEAAEWDRMHPVQAGPVAPGQIREPRGSDIAGTTSNLQEQITWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPAAIMMQKGNFRHQRKTVKCFNCGKEGHIAKNCRAPRKKGCWKCGKEGHQMKDCTERQANFLGKIWPSRRGGPGNFPQGRLEPTAPPEESFRFGEETTTPPQKQDPIDKEMYPLASLRSLFGNDPSSQ

SEQ ID NO: 474 - protein, 499 aa, Human immunodeficiency virus
MGARASVLSGGELDKWEKIRLRPGGRKQYKLKHIVWASRELERFAVNPGLLETSEGCRQILGQLQPSLQTGSEELNSLSNTIAVLYCVHQRIDIKDTKEALDKIEEEQNKSKKKVQQAAADTGNSNQVSQNYPIVQNVQGQMVHQAISPRTLNAWVKVVEEKAFSPEVIPMFSALSEGATPSDLNTMLNTVGGHQAAMQMLKETINEEAAEWDRLHPVHAGPIAPGQMREPRGSDIAGTTSTLQEQIAWMTNNPPIPVGDIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQASNATNIMMQRGNFRTQRRIVRCFNCGKEGHIAKNCRAPRKKGCWRCGKEGHQMKDCSERQANFLGKIWPSHKGRPGNFLQSRPEPTAPPEESFRFGEETTPPQKQEAIDKELYPLASLKSLFGSDPSSQ

SEQ ID NO: 475 - protein, 500 aa, Human immunodeficiency virus
  variant (23)..(23): Xaa can be any naturally occurring amino acid
  variant (26)..(26): Xaa can be any naturally occurring amino acid
  variant (40)..(40): Xaa can be any naturally occurring amino acid
  variant (51)..(51): Xaa can be any naturally occurring amino acid
  variant (104)..(104): Xaa can be any naturally occurring amino acid
  variant (489)..(489): Xaa can be any naturally occurring amino acid
MGARASVLSGGKLDKWERIRLRXGGXKRYKLKHIVWASRXLERFAVNPGLXETSEGCKQILIQLQPSLKTGSEELKSLFNTVATLYCVHQGIEVRDTKEALDKXEEEQNKGKKKAQQAQQAAADTGNNSQVSQNYPIVQNIQGQMVHQPLSPRTLNAWVKVIEDKAFSPEVIPMFTALSEGATPQDLNTMLNTVGGHQAAMQMLKETINEEAAEWDRLHPVQAGPVAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLVQNANPDCKTILKALGPGASLEEMMTACQGVGGPSHKARVLAEAMSQATNQNTIMMQRGTFRNQRKTVKCFNCGKEGHIARNCRAPRKKGCWKCGQEGHQMKDCTERQANFLGRIWPSHKGRPGNFLQSRPEPSAPPAESFGFGEEGTTPPQKQEQKDKELYPXASLRSLFGNDP

SEQ ID NO: 476 - protein, 506 aa, Human immunodeficiency virus
  variant (230)..(230): Xaa can be any naturally occurring amino acid
  variant (438)..(438): Xaa can be any naturally occurring amino acid
MGARASVLSGGKLDHWEKIRLRPGGKKKYKLKHIVWASRELERFAVNPGLLETAEGCRQILGQLQPALQTGSEELKSLYNTVAVLYCVHQRIEIKDTKEALDKIEEEQNKSKKKAQQAAAAAADTGNSSQVSQNYPIVQNLQGQMVHQALSPRTLNAWVKVIEERAFSPEIIPMFSALSEGATPQDLNTMLNTVGGHQAAMQMLKETINEEAADWDRLHPVHAGPAAPGXMREPRGSDIAGTTSTLQEQIGWMTSNPAIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPSHKARILAEAMSQVTNQSTIMIQRGNFRGQGKIVKCFNCGKVGHIARNCRAPRKRGCWKCGKEGHQMKECTEGQANFLXKIWPSHKGRPGNFLQSRPEPTAPPEPTAPPAESFRFGEETTTPSQKQEPIDKELYPLTSLRSLFGNDH

SEQ ID NO: 477 - protein, 500 aa, Human immunodeficiency virus
  variant (10)..(10): Xaa can be any naturally occurring amino acid
  variant (13)..(13): Xaa can be any naturally occurring amino acid
  variant (26)..(26): Xaa can be any naturally occurring amino acid
  variant (61)..(61): Xaa can be any naturally occurring amino acid
  variant (135)..(135): Xaa can be any naturally occurring amino acid
  variant (331)..(331): Xaa can be any naturally occurring amino acid
MGARASVLSXGEXDRWEKIRLRPGGXKRYRLKHLVWASRELERFAVNPGLLETSEGCRLIXNQLQPSLQTGSEELKSLYNTVATIYCVHQRIDVKDTKEALEKIEEEQNKSKKKAQQAAADTGNTSQVSQNYPIXQNLQGQMVHQAISPRTLNAWVKVIEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPISILDIKQGPKEPFRDYVDRFYKTLRAEQATQEVKNWMTETLLVQNANPDCXTILKALGPAATLEEMMTACQGVGGPGHKARVLAEAMSQVTNSATIMMQRGNFRNQRKTVKCFNCGKEGHIARNCRAPRKKGCWKCGKEGHQMKDCTERQANFLGKIWPSSKGRPGNFLQSRPEPTAPPEEIFRFGKETTTPSQKQEPIDKEGSPLASLKSLFGNDPSSQ

SEQ ID NO: 478 - protein, 502 aa, Human immunodeficiency virus
  variant (64)..(64): Xaa can be any naturally occurring amino acid
  variant (74)..(74): Xaa can be any naturally occurring amino acid
  variant (76)..(76): Xaa can be any naturally occurring amino acid
  variant (90)..(90): Xaa can be any naturally occurring amino acid
  variant (95)..(95): Xaa can be any naturally occurring amino acid
  variant (111)..(111): Xaa can be any naturally occurring amino acid
  variant (115)..(115): Xaa can be any naturally occurring amino acid
  variant (126)..(126): Xaa can be any naturally occurring amino acid
  variant (128)..(128): Xaa can be any naturally occurring amino acid
  variant (139)..(139): Xaa can be any naturally occurring amino acid
  variant (220)..(220): Xaa can be any naturally occurring amino acid
  variant (307)..(307): Xaa can be any naturally occurring amino acid
  variant (323)..(323): Xaa can be any naturally occurring amino acid
  variant (377)..(377): Xaa can be any naturally occurring amino acid
  variant (421)..(421): Xaa can be any naturally occurring amino acid
  variant (445)..(445): Xaa can be any naturally occurring amino acid
  variant (485)..(485): Xaa can be any naturally occurring amino acid
  variant (489)..(489): Xaa can be any naturally occurring amino acid
  variant (492)..(492): Xaa can be any naturally occurring amino acid
MGARASVLSGGKLDRWEKIRLRPGGKKKYQLKHIVWASRELERFALNPGLLETSEGCKQILGQXHPSLQTGSEXLXSLYNTIATLYCVHXNIEVXDTKEALEKVEEEQNQXKKKXQQAAAATGNSXSXVSQNYPIVQNXQGQMVHQAISPRTLNAWVKVVEEKAFSPEVIPMFSALSEGATPQDLNTMLNTVGGHQAAMQMLKETINEEAAEWDRLHPVXAGPVAPGQMREPRGSDIAGTTSTLQEQIGWMTNNPPIPVGEIYKRWIILGLNKIVRMYSPASILDIRQGPKEPFRDYVDRFYKTLRXEQASQEVKNWMTETLXVQNANPDCKTILKALGPGATLEEMMTACQGVGGPGHKARVLAEAMSQVTNSANXIMMQRGNFRNQRKNVKCFNCGKEGHIARNCRAPRKKGCWKCGKXGHQMKDCTERQANFLGKIWPSHKXRPGNFLQSRPEPTAPPEESFRFGEETTTPSQKQEPRDKEXYPLXSLXSLFGNDPSSQ

SEQ ID NO: 479 - protein, 506 aa, Human immunodeficiency virus
  variant (11)..(11): Xaa can be any naturally occurring amino acid
  variant (161)..(161): Xaa can be any naturally occurring amino acid
  variant (183)..(183): Xaa can be any naturally occurring amino acid
  variant (188)..(188): Xaa can be any naturally occurring amino acid
  variant (228)..(228): Xaa can be any naturally occurring amino acid
  variant (330)..(330): Xaa can be any naturally occurring amino acid
  variant (337)..(337): Xaa can be any naturally occurring amino acid
  variant (361)..(361): Xaa can be any naturally occurring amino acid
  variant (363)..(363): Xaa can be any naturally occurring amino acid
  variant (484)..(484): Xaa can be any naturally occurring amino acid
MGARASVLSGXQLDRWEKIRLRPGGRKQYKLKHIVWASRELERFALNPGLLETSEGCRQILGQLQPSLQTGSEELRSLFNTVATLYCVHQRIEVKDTKEALEKIEEEQNKSKKKVQQAAADTGNNSPVSQNYPIVQNMQGQMVHQAISPRTLNAWVKVVEXKAFSPEVIPMFSALSEGATPQXLNTMXNTVGGHQAAMQMLKETINEEAAEWDRLHPVHAGPPAPGQXREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNSNPDXKTILKAXGPAATLEEMMTACQGVGGPGHKAXIXAEAMSQVTSSATIMMQKGNFRNQRKPIKCFNCGKEGHIARNCKAPRKKGCWKCGSEGHQMKDCTGRQANFLGKIWPSHKGRPGNFLQSRPEPTAPPEPTAPPAESFRFGGETTTPPQKQEXIDKELYPLASLKSLFGNDPSSQ

SEQ ID NO: 480 - protein, 503 aa, Human immunodeficiency virus
  variant (35)..(35): Xaa can be any naturally occurring amino acid
  variant (78)..(78): Xaa can be any naturally occurring amino acid
  variant (94)..(94): Xaa can be any naturally occurring amino acid
  variant (112)..(112): Xaa can be any naturally occurring amino acid
  variant (120)..(120): Xaa can be any naturally occurring amino acid
  variant (127)..(127): Xaa can be any naturally occurring amino acid
  variant (164)..(164): Xaa can be any naturally occurring amino acid
  variant (206)..(206): Xaa can be any naturally occurring amino acid
  variant (308)..(308): Xaa can be any naturally occurring amino acid
  variant (364)..(364): Xaa can be any naturally occurring amino acid
  variant (431)..(431): Xaa can be any naturally occurring amino acid
  variant (453)..(453): Xaa can be any naturally occurring amino acid
  variant (459)..(459): Xaa can be any naturally occurring amino acid
MGARASVLSGGKLDKWEKIRLRPGGKKQYRLKHIXWASRELERFAINPGLLETSGGCRQILEQLQPSLKTGSEELRSXFNTIATLYCVHQNIEXKDTKEALDKIEEEQNKSXKKAQQAAXDTGNSSXQVSQNYPIVQNMQGQMVHQALSPRTLNAWVKVVEEKXFSPEVIPMFSALSEGATPQDLNTMLNTVGGHQAAMQMLKETXNEEAAEWDRLHPVHAGPIAPGQMREPRGSDIAGTTSTLQEQIGWMTHNPPIPVGEIYKRWIILGLNKIVRMYSPVSILDIRQGPKEPFRDYVDRFYRTLRAXQASQDVKNWMTETLLVQNANPDCKTILKALGPAATLEEMMTACQGVGGPGHKARVXAEAMSLVNPTTIMMQRGNFRNQRKIVKCFNCGKEGHIAKNCRAPRKKGCWKCGKEGHQMKECTERQXNFLGKIWPSHKGRPGNFLQSRXEPTAPXEPTAPPEESFRFGEETTAPSQKQEPIDKEKYPLASLRSLFGNDP

SEQ ID NO: 481 - protein, 497 aa, Human immunodeficiency virus
MGARASILSGGELDRWEKIRLRPGGKKKYKLKHVVWASRELEKFAINPGLLETSEGCRQILGQLQSALKTGSEEFKSLYNTVAVLYCVHEKIDVKDTKEALEKIEEEQNKSKKKAQQAAADTGNRNPVSQNYPIVQNLQGQMVHQAISPRTLNAWVKVVEEKAFSPEVIPMFSALSEGATPQDLNTMLNTVGGHQAAMQMLKETINEEAAEWDRLHPVPAGPVAPGQIRDPRGSDIAGTTSTLQEQIAWMTNNPPIPVGEIYKRWIIMGLNKIVRMYSPTSILDIRQGPKEPFRDYVDRFYKTLRAEQASQEVKNWMTETLLVQNANPDCKTILKALGPNPTLEEMMTACQGVGGPSHKARVLAEAMSQATNSATIMMQRGNPRTQRKMVKCFNCGKEGHIAKNCRAPRKKGCWKCGKEGHQMKDCTERQANFLGKIWPSSRGRPGNFPQSRLEPTAPPEESLRKETATPPQKQETRDELYPLTSLRSLFGNDPSSQ

SEQ ID NO: 482 - protein, 500 aa, Human immunodeficiency virus
  variant (22)..(22): Xaa can be any naturally occurring amino acid
  variant (40)..(40): Xaa can be any naturally occurring amino acid
  variant (58)..(58): Xaa can be any naturally occurring amino acid
  variant (109)..(109): Xaa can be any naturally occurring amino acid
  variant (118)..(118): Xaa can be any naturally occurring amino acid
  variant (121)..(121): Xaa can be any naturally occurring amino acid
  variant (146)..(146): Xaa can be any naturally occurring amino acid
  variant (148)..(148): Xaa can be any naturally occurring amino acid
  variant (164)..(164): Xaa can be any naturally occurring amino acid
  variant (168)..(168): Xaa can be any naturally occurring amino acid
  variant (185)..(185): Xaa can be any naturally occurring amino acid
  variant (252)..(252): Xaa can be any naturally occurring amino acid
  variant (268)..(268): Xaa can be any naturally occurring amino acid
  variant (275)..(275): Xaa can be any naturally occurring amino acid
  variant (278)..(278): Xaa can be any naturally occurring amino acid
  variant (280)..(280): Xaa can be any naturally occurring amino acid
  variant (286)..(286): Xaa can be any naturally occurring amino acid
  variant (295)..(295): Xaa can be any naturally occurring amino acid
  variant (304)..(304): Xaa can be any naturally occurring amino acid
  variant (309)..(309): Xaa can be any naturally occurring amino acid
  variant (326)..(326): Xaa can be any naturally occurring amino acid
  variant (340)..(340): Xaa can be any naturally occurring amino acid
  variant (416)..(416): Xaa can be any naturally occurring amino acid
MGARASVLSGGELDRWEKIRLXPGGKKKYKLKHIVWASRXLERFAVNPGLLETSEGCXQILGQLQPSLQTGSEELKSLFNTIAVLYCVHRRINVKDTKEALEKIEEEQXESKKRAQQXEAXTKNSSQVSQNYPIVQNLQGQMVHQXIXPRTLNAWVKVIEEKAXSPEXIPMFTALSEGATPQDLXTMLNTVGGHQAAMQMLKETINEEAAEWDRLHPVHAGPIAPGQMREPRGSDIAGTTSTLQEQIGWMTXNPPIPVGEIYKRWIIXGLNKIVXMYXPXSILDIXQGPKEPFRXYVDRFYKTXRAEQXSQEVKNWMTETLLVQNXNPDCKTILKALGPXATLEEMMTACQGVGGPGHKARVLAEAMSQVTNSATILMQRGNIRNQRKTVKCFNCGKEGHIARNCRAPRKKGCWKXGREGHQMKDCTERQANFLGKIWPSHKERPGNFLQSRPEPTAPPAESFRFGEETTTPAQKQETIDKELYPLTSLKSLFGNDPSSQ

SEQ ID NO: 483 - protein, 499 aa, Human immunodeficiency virus
  variant (24)..(24): Xaa can be any naturally occurring amino acid
  variant (230)..(230): Xaa can be any naturally occurring amino acid
  variant (316)..(316): Xaa can be any naturally occurring amino acid
  variant (339)..(339): Xaa can be any naturally occurring amino acid
  variant (435)..(435): Xaa can be any naturally occurring amino acid
  variant (478)..(478): Xaa can be any naturally occurring amino acid
MGARASVLSGGELDRWEKIRLRPXGKKQYRLKHIVWASRELERFAVNPGLLETSDGCRKILIQLQPSLQTGSEELKSLYNTVATLYCVHQRIDVRDTKEALDKIEEEQNKSKKKAQQTAAADPGNSSQVSQNYPIVQNLQGQMVHQAISPRTLNAWVKVVEEKAFSPEVIPMFSALSEGATPQDLNTMLNTVGGHQAAMQMLKETINEEAAEWDRMHPVHAGPIAPGQMXEPRGSDIAGTTSTLQEQIGWMTSNPPIPVGEIYKRWIILGLNKIVRMYSPTSILDIKQGPKEPFRDYVDRFYKVLRAEQASQDVKXWMTETLLVQNANPDCKTILKALXPAATLEEMMTACQGVGGPGHKARVLAEAMSKVTSSNTIMIQGGNFKNQRKIKCFNCGKEGHIARNCRAPRKKGCWKCGREGHQMKDCTERQANFLXKIWPSHKGRPGNFLQNRTEPTAPPEESFMFGEETTPSQRQESXDKEMYPLTSLKSLFGNDPSSQ

SEQ ID NO: 484 - protein, 503 aa, Human immunodeficiency virus
  variant (15)..(15): Xaa can be any naturally occurring amino acid
  variant (25)..(25): Xaa can be any naturally occurring amino acid
  variant (49)..(49): Xaa can be any naturally occurring amino acid
  variant (73)..(73): Xaa can be any naturally occurring amino acid
  variant (105)..(105): Xaa can be any naturally occurring amino acid
  variant (450)..(450): Xaa can be any naturally occurring amino acid
MGARASILSGGELDXWEKIRLRPGXKKQYRLKHLVWASRELERFAVNPXLLETSEGCRQIIGQLQPSLQTGSXELRSLFNTVAVLYCVHQKIEVRDTKEALDKIXEEQNKSKKKAQQAAAAAANTGSSSTVSQNYPIVQNLQGAMVHQPLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQATQEVKNWMTETLLVQNANPDCKTILKALGPAATLEEMMTACQGVGGPGHKARVLAEAMSQMTNPGTIMMQRGNFRNQRKTIKCFNCGKEGHIAKNCRAPRKKGCWKCGREGHQMKDCTERQANFLGKIWPSHKGRPGXFLQSRPEPTAPPAESFRFGEETTTPPQKQEPIDKEMYPLASLRSLFGNDPSSQ

SEQ ID NO: 485 - protein, 504 aa, Human immunodeficiency virus
  variant (197)..(197): Xaa can be any naturally occurring amino acid
MGARASVLSGGKLDKWEKIRLRPGGKKRYKLKHIVWASRELERFAVNPGLLETAEGCRQILGQLHPSLQTGSEELKSLYNTVAVLYCVHQNIEIKDTKEALDKIEEEQNKSKKKVQQAAAAAADTGNSSNQVSQNYPIVRNIQGQMVHQAISPRTLNAWVKVVEEKAFSPEVIPMFSALSEGATPQDLNTMLNTVGXHQAAMQMLKETINEEAAEWDRMHPVHAGPIAPGQMREPRGSDIAGTTSTLQEQIDWMTHNPPIPVGEIYKRWIILGLNKIVRMYSPTSILDIKQGPKEPFRDYVDRFYKTLRAEQATQDVKNWMTETLLVQNANPDCKTILKALGPAATLEEMMTACQGVGGPGHKARVLAEAMSQVTGSATIMMQKGNFKNQRRIVKCFNCGREGHIARNCRAPRKKGCWKCGKEGHQMKDCTERQANFLGKIWPSHKGRPGNFLQNRPEPSAPPEESFRFGEETTTPSQKQEPIDKETYPLASLKSLFGNDLLSQ

SEQ ID NO: 486 - protein, 508 aa, Human immunodeficiency virus
  variant (34)..(34): Xaa can be any naturally occurring amino acid
  variant (147)..(147): Xaa can be any naturally occurring amino acid
  variant (237)..(237): Xaa can be any naturally occurring amino acid
  variant (384)..(384): Xaa can be any naturally occurring amino acid
  variant (413)..(413): Xaa can be any naturally occurring amino acid
  variant (436)..(436): Xaa can be any naturally occurring amino acid
  variant (460)..(460): Xaa can be any naturally occurring amino acid
MGARASILTGGELDRWEKIRLRPGGKKKYRLKHXVWASRELERFAVNPGLLETSEGCRQILEQLQPSLQTGSEELRSLYNTVAVLYCVHQKIDVKDTKEALDKIEEEQNKSKKKAQQAAAAAADTGNSSKVSQNYPIVQNMQGQMVXQPISPRTLNAWVKVVEEKAFSPEVIPMFSALSEGATPQDLNTMLNTVGGHQAAMQMLKETINEEAADWDRLHPVHAGPVAPGQMREPRGXDIAGTTSTLQEQIGWMTNNPPIPVGEIYKRWIILGLNKIVRMYSPTSILDIKQGPKEPFRDYVDRFYKVLRAEQASQEVKNWMTETLLVQNANPDCKTILKALGPAATLEEMMTACQGVGGPGHKARVLAEAMSQVTNASAAIMMQXGNFRTPGKTVKCFNCGKEGHIARNCRAPXKRGCWKCGKEGHQMKDCTERQAXFLGKIWPSHKGRPGNFHQSRLEPXAPPEESFRFKEEITPPSQKQEPIDKEIDKETYPLASLRSLFGNDPSSQ

SEQ ID NO: 487 - protein, 498 aa, Human immunodeficiency virus
  variant (451)..(451): Xaa can be any naturally occurring amino acid
MGARASVLSGGKLDKWEKIRLRPGGRKKYQLKHIVWASRELERFAINPGLLETSEGCRQILGQLQPALQTGSEEFRSLYNTVATLYCVHQRIEIKDTKEALDKIEEEQNTSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQLREPRGSDIAGTTSSLQEQIAWMTHNPPIPVGDIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTHPAIMMQRGNFKNQRKIVKCFNCGKEGHIAKNCRAPRKKGCWKCGKEGHQMKDCTERQANFLGKIWPSHKGRPGNFPQSXLEPTAPPEESFRFGEETAPFQKQERVDRELPPLTSLKSLFGNDPSSQ

SEQ ID NO: 488 - protein, 504 aa, Human immunodeficiency virus
  variant (14)..(14): Xaa can be any naturally occurring amino acid
MGARASVLSAGELXRWEKIRLRPGGKKKYRLKHIVWASRELERFAVNPGLLETSEGCKQILGQLQPSLQTGSEELKSLFNTIAVLYCVHRKIDVKDTKEALEKIEEEQNKVKEKAKQATTDTRNSSQVSQNYPIVQNMQGQMVHQAISPRTLNAWVKVIEEKAFSPEIIPMFSALSEGATPQDLNTMLNTVGGHQAAMQMLKETINEEAADWDRLHPVQAGPVAPGQMREPRGSDIAGTTSNLQEQIGWMTSNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSGAIMMQKGNFRNQRKTVKCFNCGKEGHIARNCRAPRKRGCWKCGKEGHQMKDCTERQANFLGKIWPSHKGRPGNFLQGRPESRPEPTAPPEESFRFGEETTTPPQKQETIDKELYPLASLRSLFGNDPSSQ

SEQ ID NO: 489 - protein, 497 aa, Human immunodeficiency virus
  variant (109)..(109): Xaa can be any naturally occurring amino acid
  variant (132)..(132): Xaa can be any naturally occurring amino acid
  variant (139)..(139): Xaa can be any naturally occurring amino acid
  variant (376)..(376): Xaa can be any naturally occurring amino acid
  variant (379)..(379): Xaa can be any naturally occurring amino acid
  variant (383)..(383): Xaa can be any naturally occurring amino acid
  variant (402)..(402): Xaa can be any naturally occurring amino acid
MGARASVLSGGELDKWEKIRLRPGGKKQYKLKHIVWASRELERFAVNPGLLETSEGCRQILGQLQPSLQTGSEELRSLYNTVATLYCVHQKIDVRDTKEALDKIEEEQXKSKKKAQQAAAADTGNSKQVSQXYPIVQNXQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTNSNXIMXQRGXFRNQRKIIKCFNCGKEGHXARNCRAPRKKGCWKCGKEGHQMKDCTERQANFLGKVWPSHKGRPGNFLQNRPEPSAPPAESFRFGEETTPPQKQEQTDKEPYPLTSLKSLFGSDP

SEQ ID NO: 490 - protein, 486 aa, Human immunodeficiency virus
  variant (122)..(122): Xaa can be any naturally occurring amino acid
MGARASVLSAGELDRWEKIRLRPGGKKKYRLKHIIWASRELERFAVNPGLLETATGCRQILGQLQPSLQTGSEELRSLYNTIATLYCVHQKIEVKDTKEALDKIEEEQNKSKRAAQQAATGXGNSSQVSQNYPIVQNLQGQMVHQPIAPRTLNAWVKVIEEKAFSPEVIPMFTALSEGATPQDLNTMLNTVGGHQAAMQMLKETINEEAAEWDRLHPPQAGPLPPGQIREPRGSDIAGTTSNLQEQITWMTGNPPIPVGEIYKRWIVMGLNKIVRMYSPTSILDIRQGPKEPFRDYVDRFYKTLRAEQASQEVKNWMTETLLVQNANPDCKTILKALGPGASLEEMMTACQGVGGPSHKARVLAEAMSQVANPATVMMQRGNYKNQRKTVKCFNCGKEGHIAKNCRAPRKKGCWKCGREGHQMKDCTERQANFLGNFLQNRPEPTAPPEESFSFGGEITTPPQKQELTDKELYPSASLKSLFGNDH

SEQ ID NO: 491 - protein, 501 aa, Human immunodeficiency virus
  variant (349)..(349): Xaa can be any naturally occurring amino acid
  variant (417)..(417): Xaa can be any naturally occurring amino acid
  variant (486)..(486): Xaa can be any naturally occurring amino acid
MGARASVLSGGQLDKWEKIRLRPGGKKKYQLKHIVWASRELERFAVNPGLLETSGGCKQILGQLHPSLQTGSEELKSLYNTVAVLYCVLQGIEVKDTKEALDKIEEEQNKSKKAQQAAADAGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGEIYKRWIIMGLNKIVRMYSPTSILDIKQGPKEPFRDYVDRFYKTLRAEQASQEVKGWMTETLLVQNANPDCKTILKALGPGATLEEMMTAXQGVGGPSHKARILAEAMSQVTNQNAIMMQRGNFKNQRKTVKCFNCGKEGHIARNCRAPRKRGCWKCGXEGHQMKDCTERQANFLGKIWPSHKGRPGNFLQNRPEPTAPPMESFREETTAPSQKQETIDRDRDKELYXLASLRSLFGNDPSSQ

SEQ ID NO: 492 - protein, 501 aa, Human immunodeficiency virus
  variant (30)..(30): Xaa can be any naturally occurring amino acid
  variant (276)..(276): Xaa can be any naturally occurring amino acid
  variant (376)..(376): Xaa can be any naturally occurring amino acid
  variant (403)..(403): Xaa can be any naturally occurring amino acid
  variant (486)..(486): Xaa can be any naturally occurring amino acid
  variant (488)..(488): Xaa can be any naturally occurring amino acid
MGARASVLSGGKLDRWEKIRLRPGGKKKYXLKHLVWASRELERFAVNPGLLETSGGCRQILEQLQPSLKTGSEELKSLFNTVATLYCVHQGIDIKDTKEALDKIEEEQNESKKKAQQAAADTGNSSGQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSNLQEQIGWMTNNPPIPVGEIYKRWIILGLNKIVXMYSPTSILDIKQGPKEPFRDYVDRFYKTLRAEQASQEVKNWMTETLLVQNANPDCKTILKALGPGATLEEMMTACQGVGGPSHKARVLAEAMSHMTNPAXIMMQRGNFRNQRKIVKCFNCGKEGHIXKNCRAPRKKGCWKCGKEGHQMKDCAERQANFLGKIWSSHKGRPGNFLQSRPEPTAPPEESFRFGEETTTPSQKQGPIYKELYXLXSLRSLFGNDPSSQ

SEQ ID NO: 493 - protein, 501 aa, Human immunodeficiency virus
  variant (303)..(303): Xaa can be any naturally occurring amino acid
  variant (374)..(374): Xaa can be any naturally occurring amino acid
  variant (501)..(501): Xaa can be any naturally occurring amino acid
MGARASVLSAGELDKWEKIRLRPGGKKKYRLKHIVWASRELERFAVNPGLLETSEGCRQILGQLQPSLQTGSEELRSLYNTVATLYCVHQKIEVKDTKEAVDKVEEEQNKSKKKAQQAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKXLRAEQASQEVKNWMTETLLVQNANPDCKTILKALGPAATLEEMMTACQGVGGPGHKARVLAEAMSQVTSSXIMMMQKGNFRNQKRAIKCFNCGKEGHIAKNCRAPRRKGCWKCGKEGHQMKDCTNERQANFLGKIWPSHKGRPGNFLQSRPEPSAPPEESFRFGEEATAPSQKQEQTDKELYPLASLKSLFGNDPLSX

SEQ ID NO: 494 - protein, 500 aa, Human immunodeficiency virus
  variant (40)..(40): Xaa can be any naturally occurring amino acid
  variant (78)..(78): Xaa can be any naturally occurring amino acid
  variant (82)..(82): Xaa can be any naturally occurring amino acid
  variant (116)..(116): Xaa can be any naturally occurring amino acid
  variant (162)..(162): Xaa can be any naturally occurring amino acid
  variant (175)..(175): Xaa can be any naturally occurring amino acid
  variant (315)..(315): Xaa can be any naturally occurring amino acid
  variant (443)..(443): Xaa can be any naturally occurring amino acid
  variant (462)..(462): Xaa can be any naturally occurring amino acid
MGARASVLSGGKLDRWEKIRLRPGGKKKYKLKHLVWASRXLERFAVNPGLLETSEGCRQILSQLQPSLQTGSEELKSXFNTXATLYCVHQNIEVKDTKEALDKIEEEQNKSKKKAXQAAADTGNSNQVSQNYPIVQNLQGQMVHQPIAPRTLNAWVKVVEEXAFSPEVIPMFAAXSEGATPQDLNTMLNTVGGHQAAMQMLKETINEEAAEWDRLHPVQAGPIAPGQMREPRGSDIAGTTSTLQEQIAWMTNNPAIPVGEIYKKWIIIGLNKIVRMYSPTSILDIRQGPKEPFRDYVDRFYKTLRAEQASQDVKXWMTETLLVQNANPDCKTILKALGPGATLEEMMTACQGVGGPSHKARVLAEAMSHVSNPTTIMMQKGNFKNQRKTVKCFNCGKEGHIARNCRAPRKKGCWKCGREGHQMKDCTERQANFLGKIWPSRRXRPGNFLQNRLEPTAPPEEXLRFGEETTAPSQKQEKADKELYPLASLRSLFGNDPSSQ

SEQ ID NO: 495 - protein, 498 aa, Human immunodeficiency virus
  variant (458)..(458): Xaa can be any naturally occurring amino acid
MGARASILSGGGLDRWEKIRLRPGGRKKYKLKHLVWASRELERFAINPGLLETSEGCRQILGQLQSSLQTGSEELKSLYNTIATLYCVHQKIDVKDTKEALDKIEEEQNKKKAQQAAADTGSNKQVSQNYPIVQNIQGQMVHQPLSPRTLNAWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSNAVMMQRGNFRNQRKVIKCFNCGREGHIAKHCRAPRKKGCWKCGKEGHQMKDCTERQANFLGKIWPSSKGRPGNFLQSRPEPTAPPXESFSFREEKTTPPQKQEQIDKELYPLSSLRSLFGNDPSSQ

SEQ ID NO: 496 - protein, 502 aa, Human immunodeficiency virus
MGARASVLSGGELDRWKKIRLRPGGKKKYKLKHIVWASRELERFAVNPGLLETSGGCKQILAQLQPSLQTGSEELKSLFNTVAVLYCVHQKIEVKDTKEALDKIEEEQNKSMKKAQQTAAGTGNSSQVSQNYPIVQNLQGQMVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPTSILDIRQGPKEPFRDYVDRFYKTLRAEQATQEVKNWMTETLLVQNSNPDCKTILKALGPGATLEEMMTACQGVGGPGHKARVLAEAMSQATNSANIIMMQRGNFRNQRKIIKCFNCGREGHIAKNCRAPRKKGCWKCGKEGHQMKDCTERQANFLGKIWPSNKGRPGNFLQSRPEPTAPPEESFRFGEETTASPQKQEPINKELYPPLASLRSLFGNDPSSQ

SEQ ID NO: 497 - protein, 501 aa, Human immunodeficiency virus
  variant (14)..(14): Xaa can be any naturally occurring amino acid
  variant (26)..(26): Xaa can be any naturally occurring amino acid
  variant (385)..(385): Xaa can be any naturally occurring amino acid
MGARASVLSGGQLXKWEKIRLRPGGXKRYRLKHLVWASRELERFAVNPGLLETSEGCRQILGQLQPSLETGSEELRSLYNTVATLYCVHQGIGIKDTKEALEKVEEEQNKSKKKAQQVAAAAGAGNSSQVSQNYPIVQNLQGQMVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARVLAEAMSQANSTTIMMQKGNFXNQRKMVKCFNCGKEGHIARNCRAPRKKGCWKCGKEGHQMKDCTERQANFLGKIWPSHKGRPGNFLQSRPEPTAPPEESFRFGGETTTPSQKQEPIDKELYPLASLKSLFGNDPSSQ

SEQ ID NO: 498 - protein, 506 aa, Human immunodeficiency virus
MGARASVLSGGELDRWEKIRLRPGGKKRYKLKHIVWASRELERFALNPGLLETAGGCRQIIAQLHPSLQTGSEELKSLFNTVATLYCVHQRIDVKDTKEALEKIEEEQNKSKKKAQQAAADTGNSSQENSSQISQNYPIIQNLQGQMVHQAISPRTLNAWVKVVEEKAFSPEVIPMFSALSEGATPQDLNTMLNTVGGHQAAMQMLKETINEEAAEWDRLHPVHAGPAAPGQMREPRGSDIAGSTSTLQEQIGWMTSNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPSHKAKVLAEAMSQTTSSAAIMMQKGNLRNPKKPVKCFNCGKEGHIAKNCRAPRKKGCWKCGREGHQMKDCTERQANFLGKIWPSHKGRPGNFFQSGLEPTAPPEESFRFGEATATPPQKQEPIDKEPLYPLTSLKSLFGNDPSSQ

SEQ ID NO: 499 - protein, 503 aa, Human immunodeficiency virus
  variant (82)..(82): Xaa can be any naturally occurring amino acid
MGARASVLSGGELDKWERIRLRPGGRKKYRLKHIVWASRELERFAVNPGLLETSEGCRQILGQLQPALQTGSEELRSLYNTXATLYCVHQKIEVKDTKEALEKIEEEQNKSKKKAQAQQAAAGAGNNSPASQNYPIVQNIQGQMVHQPISPRTLNAWVKVVEEKAFSPEVIPMFSALAEGATPQDLNTMLNTVGGHQAAMQMLKETINEEAAEWDRLHPVQAGPVAPGQMREPRGSDIAGTTSTLQEQIGWMTGNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQATSSAAAIMMQRGNFRNQRKSIKCFNCGREGHLARNCKAPRKKGCWKCGKEGHQMKDCTERQANFLGKIWPSHKGRPGNFLQNRPEPTAPPEESFKFGEETATPPQKQEPIDKELYPLTSLRSLFGSDPSSQ

SEQ ID NO: 500 - protein, 502 aa, Human immunodeficiency virus
MGARASILSSGQLDRWEKIRLRPGGKKKYRLKHIVWASRELERFAVNPGLLETSEGCRKILEQLQPSLQTGSEELKSLYNTVATLYCVHLKIDIKDTKEALDKIEEEQNKSKKKAQQAAAAADTGNSNQVSQNYPIVQNLQGQMVHQNMSPRTLNAWVKVIEEKAFSPEVIPMFSALSEGATPQDLNTMLNTVGGHQAAMQMLKETINEEAAEWDRLHPVQAGPVAPGQIREPRGSDIAGTTSTLQEQIAWMTHNPPIPVGEIYKRWIILGLNKIVRMYSPVSILDIRQGPKEPFRDYVDRFYKTLRAEQASQDVKNWMTETLLVQNANPDCKTILKALGPAASLEEMMTACQGVGGPGHKARVLAEAMSQVTTPSAIMMQRGNFRNQRKSVKCFNCGKEGHIAKNCRAPRKRGCWKCGKEGHQMKDCTERQANFLGKIWPSHKGRPGNFLQSRPEPSAPPEESFRFGEETTTPSQKQEPIDKEIYPLASLKSLFGNDPSSQ

SEQ ID NO: 501 - protein, 500 aa, Human immunodeficiency virus
MGARASVLSGGELDRWEKIRLRPGSKKRYKLKHIVWASRELERFAVNPGLLETSGGCKQILAQLHPSLQTGSEELKSLYNTVATLYCVHQKIDVKDTKEALDKIEEEQNKSKKKAQQTAIDAGSSSQASQNYPIVQNLQGQMVHQALSPRTLNAWVKVIEEKAFSPEVIPMFTALSEGATPQDLNTMLNTVGGHQAAMQMLKETINEEAAEWDRLHPVHAGPVAPGQMREPRGSDIAGTTSTLQEQIAWITNNPPIPVGEIYKRWIILGLNKIVRMYSPVSILDIKQGPKEPFRDYVDRFYKTLRAEQATQEVKNWMTETLLVQNANPDCKTILKALGPAATLEEMMTACQGVGGPGHKARVLAEAMSQVTTSANIMMQRGNFKNQRKIVKCFNCGKEGHIAKNCRAPRKRGCWKCGQEGHQMKDCTERQANFLGKVWPSHKGRPGNFLQSRPEPTAPPAESFRFGEETTTPSQKQEPINKEQYPLASLRSLFGNDPSSQ

SEQ ID NO: 502 - protein, 501 aa, Human immunodeficiency virus
MGARASVLSGGELDRWEKIRLRPGGKKKYRLKHVVWASRELERFAVNPSLLETSEGCRQILVQLQPSLQTGSEEIKSLYNTVATLYCVHQRIDVKDTKEALEKIEEEQNKSNKKAQQAAADTGNSSSHVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNPANIMMQRGNFRNPRKTVKCFNCGKEGHIAKNCRAPRKKGCWKCGKEGHQMKDCPERQANFLGKIWPSYKGRPGNFLQSRPEPSAPPEESFRFGEETTTPSQKQEQIDKELYPLASLRSLFGNDPSSQ

SEQ ID NO: 503 - protein, 504 aa, Human immunodeficiency virus
MGARASILSGGQLDRWEKIRLRPGGKKKYKLKHIVWASRELERFAVNPGLLETAEGCRQILGQLQPSLQTGSEEIKSLYNMIATLYCVHQRIEVKDTKEALEKIEEEQNKSKKKAQQAAADAGENSKVSQNYPIVQNLQGQMVHQALSPRTLNAWVKVIEEKAFSPEVIPMFTALSEGATPQDLNTMLNTVGGHQAAMQILKETINEEAADWDRLHPVHAGPIAPGQMREPRGSDIAGTTSTLQEQIGWMTSNPPIPVGEIYKRWIILGLNKIVRMYSPVSILDIKQGPKEPFRDYVDRFYKTLRAEQASQDVKNWMTETLLVQNANPDCKTILKALGPAATLEEMMTACQGVGGPGHKARVLAEAMSQMTNSATIMMQRGNFKKQRKIVKCFNCGKEGHIAKNCRAPRKRGCWKCGKEGHQMKDCTERQANFLGKIWPSHKGRPGNFLQNRPEPVEPTAPPEESFRFGEEATTPPPQKQDTKDKELYPLASLRSLFGNDPSSQ

SEQ ID NO: 504 - protein, 500 aa, Human immunodeficiency virus
  variant (303)..(303): Xaa can be any naturally occurring amino acid
MGARASVLSGGELDKWEKIRLRPGGKKQYRLKHIVWASRELERFAVNPGLLETSEGCRQILGQLQPSLQTGSEELRSLYNTIAVLYCVHQRIEVRDTKEALDKIEEEQNKSKKKAQPAAADTGSNSQVSQNYPIVQNMQGQMVHQAISPRTLNAWVKVVEEKAFSPEVIPMFAALSEGATPQDLNTMLNTVGGHQAAMQMLKETINEEAAEWDRMHPVHAGPIAPGQMREPRGSDIAGTTSTLQEQIGWMTHNPPIPVGEIYKKWIIMGLNKIVRMYSPTSILDIKQGPKESFRDYVDRFYKXLRAEQASQEVKNWMTETLLVQNANPDCKTILKALGPAATLEEMMTACQGVGGPGHKARVLAEAMSQVTNSATVMMQRGNYRNQRKPVKCFNCGKEGHIAKNCRAPRKKGCWKCGKEGHQMKDCTERQANFLGKIWPSHKGRPGNFLQSRPEPTAPPEESFRFGEETPIPSQKQEPTDKETYPLTSLRSLFGNDPSSQ

SEQ ID NO: 505 - protein, 492 aa, Human immunodeficiency virus
  variant (15)..(15): Xaa can be any naturally occurring amino acid
  variant (226)..(226): Xaa can be any naturally occurring amino acid
MGARASVLSGGQLDXWEKIRLRPGGKKKYKLKHIVWASRELERFAVNPGLLETAEGCRQILGQLQPALQTGSEELRSLFNTVATLYCVHQKIEVKDTKEALEKVEEEQNKSKKKAQQAAADTGNSSQVSQNYPIVQNLQGQMVHQALSPRTLNAWVKVIEEKAFSPEVIPMFTALSEGATPQDLNTMLNTVGGHQAAMQMLKETINEEAAEWDRTHPVHAGPIAPXQMREPRGSDIAGTTSNLQEQIAWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVSNSATIMMQRGNFRNQRKTIKCFNCGKEGHLARNCRAPRKKGCWKCGKEGHQMKDCTERQANFLGKIWPSHKGRPGNFLQSRPEPTAPPEESFRFGEETTTDKELYPLASLKSLFGNDPSSQ

SEQ ID NO: 506 - protein, 503 aa, Human immunodeficiency virus
  variant (92)..(92): Xaa can be any naturally occurring amino acid
  variant (101)..(101): Xaa can be any naturally occurring amino acid
  variant (146)..(146): Xaa can be any naturally occurring amino acid
  variant (244)..(244): Xaa can be any naturally occurring amino acid
  variant (343)..(343): Xaa can be any naturally occurring amino acid
  variant (463)..(463): Xaa can be any naturally occurring amino acid
MGARASVLSGGKLDRWEKIRLRPGGKKKYKLKHIVWASRELERFAVNPGLLETSEGCRQILGQLQPSLQTGSEELRSLYNTVATLYCVHQNXEVRDTKEAXEKIEEEQNKSKKKAQQAAAAAGAGNSSQAASQNYPIVQNMQGQMXHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTXTLQEQIGWMTNNPPIPVGEIYKRWIILGLNKIVRMYSPISILDIRQGPKEPFRDYVDRFYKTLRAEQASQEVKNWMTETLLVQNANPDCKTILKALGPXATLEEMMTACQGVGGPGHKARVLAEAMSQVTTSNTIMMQRGNFRNQRKAVKCFNCGKEGHIAKNCRAPRKKGCWKCGKEGHQMKDCTERQANFLGKIWPSHKGRPGNFLQSRPEPTAPPXESFRFGEEATTPPQKPEPIDKELYPLASLRSLFGNDPSSQ

SEQ ID NO: 507 - protein, 499 aa, Human immunodeficiency virus
  variant (200)..(200): Xaa can be any naturally occurring amino acid
  variant (392)..(392): Xaa can be any naturally occurring amino acid
MGARASILSGGALDRWEKIRLRPGGKKKYRLKHLVWASRELERFAVNPGLLETSGGCRQILEQLQPSLQTGSEEIKSLYNTVAVLYCVHLRIDVKDTKEALDKIEEEQNKSKKKAQVTAADTGNSSKVSQNYPIVQNLQGQMVHQPISPRTLNAWVKVVEEKAFSPEVIPMFSALSEGATPQDLNTMLNTVGGHQAAMQXLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKIVKXFNCGKEGHIAKNCRAPRKKGCWKCGKEGHQMKDCIERQANFLGKIWPSNKGRPGNFLQSRPEPTAPPEESFRFGKETTTPSQKQESKEELYPLTSLRSLFGNDPSSQ

SEQ ID NO: 508 - protein, 500 aa, Human immunodeficiency virus
  variant (17)..(17): Xaa can be any naturally occurring amino acid
  variant (20)..(20): Xaa can be any naturally occurring amino acid
  variant (23)..(23): Xaa can be any naturally occurring amino acid
  variant (30)..(30): Xaa can be any naturally occurring amino acid
  variant (49)..(49): Xaa can be any naturally occurring amino acid
  variant (51)..(51): Xaa can be any naturally occurring amino acid
  variant (57)..(57): Xaa can be any naturally occurring amino acid
  variant (154)..(154): Xaa can be any naturally occurring amino acid
  variant (403)..(403): Xaa can be any naturally occurring amino acid
MGARASVLSGGELDKWXKIXLRXGGKKKYXLKHIVWASRELERFAVNPXLXETSEGXRQILGQLQPSLQTGSEELKSLFNTVAVLYCVHQRIDVKDTKEALEKIEEEQNKSQKKAQQAAADTRNSSQVSQNYPIVQNIQGQMVHQAISPRTLNXWVKVVEEKAFSPEVIPMFSALSEGATPQDLNTMLNTVGGHQAAMQMLKETINEEAAEWDRLHPVQAGPVAPGQMREPRGSDIAGTTSTLQEQIGWMTSNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFKGQRKIVKCFNCGKEGHIAXNCRAPRKKGCWRCGKEGHQMKDCTERQANFLGKIWPSHKERPGNFLQSRPEPTAPPEESFRFGEETTTPSQKQESIDKDLYPLASLRSLFGNDHSSQ

SEQ ID NO: 509 - protein, 500 aa, Human immunodeficiency virus
  variant (17)..(17): Xaa can be any naturally occurring amino acid
  variant (28)..(28): Xaa can be any naturally occurring amino acid
  variant (37)..(37): Xaa can be any naturally occurring amino acid
  variant (99)..(99): Xaa can be any naturally occurring amino acid
  variant (118)..(118): Xaa can be any naturally occurring amino acid
  variant (162)..(162): Xaa can be any naturally occurring amino acid
  variant (187)..(187): Xaa can be any naturally occurring amino acid
  variant (312)..(312): Xaa can be any naturally occurring amino acid
  variant (362)..(362): Xaa can be any naturally occurring amino acid
  variant (400)..(400): Xaa can be any naturally occurring amino acid
  variant (419)..(419): Xaa can be any naturally occurring amino acid
MGARASILSGGELDRWXKIRLRPGGKKXYRLKHLVWXSRELERFAVNPGLLETSTGCRQILQQLQPALQTGSEELKSVYNTVATLYCVHQRIDVKDTKXALEKIEEEQNKSKKKEQQXAAGTGNSSQVSQNYPIVQNLQGQMVHQAISPRTLNAWVKVVEEXAFSPEVIPMFSALSEGATPQDLNTXLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQXVKNWMTETLLVQNANPDCKTILKALGPAATLEEMMTACQGVGGPGHKARXLAEAMSQVTSPATVMIQRGNFRNQRKAVKCFNCGKEGXIAKNCRAPRKKGCWKCGKXGHQMKDCTERQANFLGKIWPSHKGRPGNFLQSRPEPSAPPEESFRFGEETTTPSQKQETIDRDLYPLASLKSLFGNDPSSQ

SEQ ID NO: 510 - protein, 501 aa, Human immunodeficiency virus
  variant (10)..(10): Xaa can be any naturally occurring amino acid
  variant (48)..(48): Xaa can be any naturally occurring amino acid
  variant (84)..(84): Xaa can be any naturally occurring amino acid
  variant (113)..(113): Xaa can be any naturally occurring amino acid
  variant (127)..(127): Xaa can be any naturally occurring amino acid
  variant (135)..(135): Xaa can be any naturally occurring amino acid
  variant (201)..(201): Xaa can be any naturally occurring amino acid
  variant (203)..(203): Xaa can be any naturally occurring amino acid
  variant (215)..(215): Xaa can be any naturally occurring amino acid
  variant (240)..(240): Xaa can be any naturally occurring amino acid
  variant (290)..(290): Xaa can be any naturally occurring amino acid
  variant (292)..(292): Xaa can be any naturally occurring amino acid
  variant (309)..(309): Xaa can be any naturally occurring amino acid
  variant (344)..(344): Xaa can be any naturally occurring amino acid
  variant (362)..(362): Xaa can be any naturally occurring amino acid
  variant (394)..(394): Xaa can be any naturally occurring amino acid
  variant (425)..(425): Xaa can be any naturally occurring amino acid
MGARASVLSXGELDKWEKIRLRPGGKKQYKLKHIVWASRELERYALNXGLLETTEGCRQILGQLQPSLQTASEELRSLYNTVAXLYCVHQRIEIRDTKEALDRIEEEQNKSKXKAQQAAADTGNSSXVSQNYPIXQNMQGQMVHQPLSPRTLNAWVKVIEEKAFSPEVIPMFSALSEGATPQDLNTMLNTVGGHQAAMQMXKXTINEEAAEWDRXHPVQAGPVAPGQIREPRGSDIAGTXSTLQEQIAWMTHNPPIPVGEIYKRWIILGLNKIVRMYSPTSILDIRQGPXEXFRDYVDRFYKTLRAEQXSQEVKNWMTETLLVQNANPDCKTILKALGPGATLXEMMTACQGVGGPSHKARXLAEAMSQVTNPTTIMMQRGNFRNQRKSVKCFXCGKEGHTARNCRAPRKKGCWKCGKEGHQMKXCTERQANFLGKIWPSHKGGRPGNFLQSRPEPTAPPEESFRFGEETTAPLQKQEKGDGELYPLTSLKSLFGNDPSSQ

SEQ ID NO: 511 - protein, 505 aa, Human immunodeficiency virus
  variant (385)..(385): Xaa can be any naturally occurring amino acid
  variant (393)..(393): Xaa can be any naturally occurring amino acid
  variant (452)..(452): Xaa can be any naturally occurring amino acid
MGARASVLSGGELDRWERIRLRPGGSKKYKLKHIIWASRELERFAVNPGLLETSEGCKQILIQIQPSLQTGSEELRSLYNTVATLYCVHQKIDVKDTKEALEKVEEEQNKSKKKAQQAADNTGSNNTGSNNQVSQNYPIVQNMQGQMVHQPISPRTLNAWVKVIEEKAFSPEVIPMFTALSEGATPQDLNTMLNTVGGHQAAMQMLKETINEEAAEWDRLHPVHAGPPVAGQMREPRGSDIAGTTSTLQEQIGWMTSNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQLTGSATVMMQXGNFRNQRXSVKCFNCGKEGHIARNCRAPRKRGCWKCGKEGHQMKDCIEGQANFLGKIWPSHKGRPGXFLQSRPEPTAPPAPPEESFRFGEETTKQEKRDQELYPPLTSLRSLFGNDPLSQ

SEQ ID NO: 512 - protein, 505 aa, Human immunodeficiency virus
  variant (487)..(487): Xaa can be any naturally occurring amino acid
MGARASILSGGQLDRWEKIRLRPGGKKQYKLKHIVWASRELERFAVNPGLLETSEGCRQILGQLQPSLQTGSEELKSLFNTVAVLYCVHQRIEVKDTKEALDKIEEEQNKSKKKAQQAAAADTGNANQVSQNYPIVQNLQGQMVHQAISPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTHNPPIPVGDIYKRWIIMGLNKIVRMYSPTSILDIRQGPKEPFRDYVDRFYKTLRAEQASQEVKNWMTETLLVQNSNPDCRTILKALGPAATLEEMMTACQGVGGPGHKARVLAEAMSQVTSPAAVMMQRGNFRNQRKSVKCFNCGKEGHIARNCRAPRKKGCWKCGKEGHQMKDCTERQANFLGKIWPSHKGGRPGNFLQSRPEPTAPPAPPEESFRFGEEITTPSQKQETKDKXMYPLTSLRSLFGNDPSSQ

SEQ ID NO: 513 - protein, 504 aa, Human immunodeficiency virus
  variant (384)..(384): Xaa can be any naturally occurring amino acid
  variant (483)..(483): Xaa can be any naturally occurring amino acid
  variant (501)..(501): Xaa can be any naturally occurring amino acid
MGARASVLSGGELDRWEKIRLRPMGKKKYRLKHIVWASRELERFAVNPGLLETSGGCRQILEQLQPSLQTGSEELRSLYNTIAVLYCVHQRIEVKDTKEALDKIEEEQNKSKKKTQQAAADAGKSSQVSQNYPIVQNLQGQMVHQAISPRTLNAWVKVVEEKAFSPEVIPMFSALAEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPATIMMQRGNFXNQRKPIKCFNCGKDGHIASKCRAPRKKGCWKCGQEGHQMRDCPGRQANFLGKILPSYKGRPGNFLQSRPEPSAPPEESFRFGEETTTPPQNPPQKQESXDKELYPLASLKSLFGNDXLSQ

SEQ ID NO: 514 - protein, 502 aa, Human immunodeficiency virus
MGARASVLRGGELDRWEKIRLRPGGKKKYKLKHLVWASRELERFAVNPGLLETSEGCKQILGQFQSSLQTGSEEFRSLYNTVATLYCVHQKIDVKDTKEALDKIEEEQNKSKKRAQQAAADTGNSNQVSQNSNQASQNYPIVQNLQGQMVHQALSPRTLNAWVKVVEEKAFSPEVIPMFSALSEGATPTDLNTMLNTVGGHQAAMQMLKETINEEAAEWDRLHPVHAGPIAPGQMREPRGSDIAGTTSTLQEQIGWMTNNPPIPVGDIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSTAIMMQRGNLRNQRKTIKCFNCGKEGHLARNCRAPRKKGCWKCGKEGHQMKDCTERQANFLGKIWPSNKGRPGNFLQSRPEPSAPPEESFREEMATPSQKQETRDKELYPLASLKSLFGNDP

SEQ ID NO: 515 - protein, 501 aa, Human immunodeficiency virus
  variant (39)..(39): Xaa can be any naturally occurring amino acid
  variant (175)..(175): Xaa can be any naturally occurring amino acid
MGARASVLSGGKLDKWEKIRLRPGGKKHYQLKHIVWASXELERFALNPGLLETSEGCKQILGQLQPALQTGSEEFKSLYNTVATLYCVHQRIDVKDTQEALEKIEEEQNKSKKKAQQAAAADTGKSSQVSQNYPIVQNLQGQMVHQAISPRTLNAWVKVVEEKAFSPEVIPMFSXLSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQLTNSATVMMQRGNFRNQRQTVKCFNCGKEGHIAKNCRAPRKKGCWKCGKEGHQMKDCIERQANFLGKIWPSHKGRPGNFLQSRPEPTAPPAPPEESFRFGEETATPSPKQEPIDKELYPSASLRSLFGNDL

SEQ ID NO: 516 - protein, 512 aa, Human immunodeficiency virus
MGARASVLSAGKLDKWEKIRLRPGGKKKYRLKHLVWASRELERFAVNPGLLETSEGCRQILEQLQPSIQTGSEELKSLFNTIATLYCVHQKIEVKDTKEALDKIEEEQNKSKKKAQQAAAGAGNSSQVSVSQNYPIVQNLQGQMVHQAISPRTLNAWVKVVEEKAFSPEVIPMFTALSEGATPQDLNTMLNTVGGHQAAMQMLKETINEEAAEWDRLHPVQAGPVAPGQMREPRGSDIAGTTSTLQEQVGWMTSNPPIPVGEIYKRWIIMGLNKIVRMYSPTSILDIRQGPKEPFRDYVDRFYKTLRAEQASQDVKNWMTETLLVQNSNPDCKTILKALGPGATLEEMMTACQGVGGPSHKARILAEAMSQVTNSATIMMQKGNFRNQRRTVKCFNCGKEGHIARNCRAPRKGGCWKCGKEGHQMKDCTSERQANFLGKIWPSNKGRPGNFLQSRPEPAQSRLEPTAPPEESFRFGEETTTPSQKQESKDRDKELYPLASLKSLFGNDPSSQ

SEQ ID NO: 517 - protein, 498 aa, Human immunodeficiency virus
  variant (203)..(203): Xaa can be any naturally occurring amino acid
  variant (378)..(378): Xaa can be any naturally occurring amino acid
  variant (396)..(396): Xaa can be any naturally occurring amino acid
  variant (430)..(430): Xaa can be any naturally occurring amino acid
  variant (440)..(440): Xaa can be any naturally occurring amino acid
MGARASVLSGGELDKWEKIRLRPGGKKQYKLKHIVWASRELERFAVNPSLLETSEGCRQILGQLQPSLQTGSEELKSLFNTVAVLYCVHQRIDIKDTKEALDKIEEEQNKSKKKTQQAAADAGSQVSQNYPIVQNLQGQMVHQPISPRTLNAWVKVVEEKAFSPEVIPMFTALSEGATPQDLNTMLNTVGGHQAAMQMLKEAXNEEAADWDRTHPVHAGPVAPGQLREPRGSDIAGTTSTLQEQIQWMTNNPPIPVGEIYKRWIILGLNKIVRMYSPSSILDIKQGPKEPFRDYVDRFYKTLRAEQASQDVKNWMTETLLVQNANPDCKTILRALGPGATLEEMMTACQGVGGPSHKARVLAEAMSQVQGPPAIMMQXGNFRNQGRIIKCFNCGKXGHIAKNCRAPRRRGCWKCGKEGHQMKDCTEKQAXFLGKIWPSHXGRPGNFLQNRPEPTAPPEESFRFGEETTTPPQKQEPIEKDLYPTASLRSLFGNDPLSQ

SEQ ID NO: 518 - protein, 498 aa, Human immunodeficiency virus
  variant (129)..(129): Xaa can be any naturally occurring amino acid
  variant (362)..(362): Xaa can be any naturally occurring amino acid
MGARASVLSGGELDRWEKIRLRPGGNKKYKLKHLVWASRELERFAVNPGLLETADGCKQIMKQLQPALQTGSEELKSLFNTVATLYCVHQRIEIKDTKEALEKIEEEQNKSKKKEAQQAAADPGNSSQXSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQINWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPGHKAXVLAEAMSQVTNSATIMMQRGNFKKQRRIVKCFNCGKEGHIARNCRAPRKKGCWKCGKEGHQMKDCTERQANFLGKIWPSHKGRPGNFLQSRPEPTAPPEESFRFGEETTTPSQKQESIDKEMYPLASLRSLFGNDP

SEQ ID NO: 519 - protein, 502 aa, Human immunodeficiency virus
  variant (74)..(74): Xaa can be any naturally occurring amino acid
  variant (280)..(280): Xaa can be any naturally occurring amino acid
  variant (290)..(290): Xaa can be any naturally occurring amino acid
  variant (409)..(409): Xaa can be any naturally occurring amino acid
  variant (461)..(461): Xaa can be any naturally occurring amino acid
  variant (501)..(501): Xaa can be any naturally occurring amino acid
MGARASVLSGGELDRWEKIRLRPGGKKKYKLKHIIWASRELERFAINPGLLETSEGCRQILGQLQPALPTGSEXCKSLFNTVAVLYCVHQRIEVKDTKEALEKIEEEQNKSKKKAQQAAADTGKSNPVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPXSILDIRQGPXEPFRDYVDRFYKTLRAEQATQEVKNWMTETLLVQNANPDCKTILKALGPAATLEEMMTACQGVGGPSHKARILAEAMSQVTNSATVMMQRGNFRNQRKIVKCFNCGKEGHIAKNCRAPXKKGCWKCGKEGHQMKDCTERQANFLGKIWPSHKGRPGNFLQSRPEPTAPTAXPEESFRFGEETIPSQKQEVIDKELYPSASLRSLFGNDPLXQ

SEQ ID NO: 520 - protein, 501 aa, Human immunodeficiency virus
MGARASILSGGELDRWEKIRLRPGGKKRYRLKHLVWASRELERFAVNPGLLETSDGCRQILIQLQPALQTGSEELKSVYNTVATLYCVHQRIDVRDTKEALDKIEEEQNKSKKKAQQAAADTGNSSQVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQMTNSANIMMQRGNFKNQRRTVKCFNCGKEGHIAKNCRAPRKKGCWKCGKEGHQMKDCTERQANFLGKIWPSHKGRPGNFLQSRPEPSAPPEESFRFGEKTITPPQKQEPIDKDERYPLTALKSLFGNDPLSQ

SEQ ID NO: 521 - protein, 510 aa, Human immunodeficiency virus
  variant (445)..(445): Xaa can be any naturally occurring amino acid
  variant (477)..(477): Xaa can be any naturally occurring amino acid
MGARASILSGGELDRWEGIRLRPGGKKKYRLKHIVWASRELDRFALNPGLLETAEGCRQILGQLQSSLPTGSEEIKSLFNTVATLYCVHQRIDVKDTKEALDKIEEEQNKSKKKAQQAAAAAGNSSNAGNSSSQVSQNYPIVQNLQGQMVHQAISPRTLNAWVKVVEEKAFSPEVIPMFTALSEGATPQDLNTMLNTVGGHQAAMQMLKETINEEAAEWDRVHPVQAGPVAPGQMREPRGSDIAGTTSTLQEQIGWMTSNPAIPVGEIYKRWIILGLNKIVRMYSPTSILDIRQGPKEPFRDYVDRFYKTLRAEQASQEVKAWMTETLLVQNANPDCKTILKALGPAPTLEEMMTACQGVGGPGHKARVLAEAMSQVTNPAAIMMQKSNFRNHRKPVKCFNCGKEGHIAKNCRAPRKRGCWKCGKEGHQMKDCTERQANFLGKIXPSHKGRPGNFLQSRPEPTAPSAPPAESFRFGXETATPSQKQEPMEKELYPSAALKSLFGNDPLSQ

SEQ ID NO: 522 - protein, 500 aa, Human immunodeficiency virus
  variant (24)..(24): Xaa can be any naturally occurring amino acid
  variant (117)..(117): Xaa can be any naturally occurring amino acid
  variant (143)..(143): Xaa can be any naturally occurring amino acid
  variant (201)..(201): Xaa can be any naturally occurring amino acid
  variant (223)..(223): Xaa can be any naturally occurring amino acid
  variant (261)..(261): Xaa can be any naturally occurring amino acid
  variant (280)..(280): Xaa can be any naturally occurring amino acid
  variant (295)..(295): Xaa can be any naturally occurring amino acid
  variant (409)..(409): Xaa can be any naturally occurring amino acid
  variant (435)..(435): Xaa can be any naturally occurring amino acid
  variant (463)..(463): Xaa can be any naturally occurring amino acid
  variant (465)..(465): Xaa can be any naturally occurring amino acid
  variant (470)..(470): Xaa can be any naturally occurring amino acid
  variant (482)..(482): Xaa can be any naturally occurring amino acid
  variant (497)..(497): Xaa can be any naturally occurring amino acid
MGARASVLSGGELDRWEKIRLRPXGKKKYRLKHIVWASRELERFAVNPGLLETSEGCRQILGQLQPALQTGSEELRSLYNTIATLYCVHQKIDIKDTKEALDKIEEEQNKSKKKAQXAAADTGNSSQVSQNYPVVQNLQGQMXYQALSPRTLNAWVKVVEEKAFSPEVIPMFTALSEGATPQDLNTMLNTVGGHQAAMQMXKETINEEAAEWDRLHPVHAGPXAPGQMREPRGSDIAGTTSTPQEQVAWMTSNPPIPVGEXYKRWIILGLNKIVRMYSPXSILDIRQGPKEPFRXYVDRFYKTLRAEQATQEVKNWMTETLLVQNANPDCKTILKALGPAATLEEMMSACQGVGGPGHKARVLAEAMSQVTNPATIMMQKGNFRNQRKSVKCFNCGREGHIAKNCRAPXKKGCWKCGKEGHQMKDCTERQANFLXKIWPSHKGRPGNFLQSRPEPTAPPEESXRXGEEMXTPAQKQEPIDKXLYPLTSLKSLFGNDXSSQ

SEQ ID NO: 523 - protein, 499 aa, Human immunodeficiency virus
MGARASVLSSGELDKWEKIRLRPGGKKRYQLKHIVWASRELERFAVNPGLLETSEGCRQILRQLQPSLQTGSEELKSLFNTVAVLYCVHQKIEVKDTKEALDKIEEEQNKSKKKEQQAAADTGNSSQVSQNYPIVQNMQGQMVHQAISPRTLNAWVKVVEEKAFSPEVIPMFAALSEGATPQDLNTMLNTVGGHQAAMQMLKETINEEAAEWDRLHPVHAGPPAPGQMREPRGSDIAGTTSTLQEQIAWMTSNPPVQVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARVLAEAMSQANSTTIMMQRGNFKNQRKGVKCFNCGKEGHIARHCKAPRRKGCWKCGKEGHQIKDCTERQANFLGKIWPSHKGRPGNFLQSRPEPTAPPAESFRFGEETTTPSQKQETVDKELYPVTSLKSLFGNDPLSQ

SEQ ID NO: 524 - protein, 506 aa, Human immunodeficiency virus
  variant (7)..(7): Xaa can be any naturally occurring amino acid
  variant (189)..(189): Xaa can be any naturally occurring amino acid
  variant (386)..(386): Xaa can be any naturally occurring amino acid
MGARASXLSGGQLDKWERIRLRPGGKKKYQLKHIVWASRELERFAVNPGLLETSEGCRQILKQLQPSLQTGSEELRSLFNTIATLYCVHQRIDVKDTKEALEKIEEEQNKSKEKAQQAAAAAATGNSSQNSSQVSQNYPIVQNLQGQMVHQAMTPRTLNAWVKVIEEKAFSPEVIPMFSALSEGATPQXLNTMLNTVGGHQAAMQILKETINEEAAEWDRLHPVHAGPIAPGQMREPRGSDIAGTTSTLQEQIGWMTNNPPIPVGDIYKRWIILGLNKIVRMYSPTSILDIKQGPKEPFRDYVDRFYKVLRAEQASQDVKNWMTETLLVQNANPDCKTILKALGPAATLEEMMTACQGVGGPGHKARVLAEAMSQMTNSAAIMMQXGNFRGQRKTVKCFNCGREGHIARNCKAPRKKGCWKCGREGHQMKDCTERQANFLGKIWSSHKGRPGNFVQNRPEPTAPPAESFGFGEEMTTPSQTQEPKDKELYPLSSLKSLFGNDPSSQ

SEQ ID NO: 525 - protein, 508 aa, Human immunodeficiency virus
  variant (214)..(214): Xaa can be any naturally occurring amino acid
  variant (377)..(377): Xaa can be any naturally occurring amino acid
  variant (393)..(393): Xaa can be any naturally occurring amino acid
  variant (405)..(405): Xaa can be any naturally occurring amino acid
  variant (411)..(411): Xaa can be any naturally occurring amino acid
  variant (429)..(429): Xaa can be any naturally occurring amino acid
  variant (469)..(469): Xaa can be any naturally occurring amino acid
MGARASVLSGGKLDQWEKIRLRPMGKKKYKLKHIVWASRELERFALNANLLETSEGCKQIMEQLQPALNTGTEELKSLFNTVATLYCVHKRIEVKDTKEALDKVEEEQNKSKKKAPQAAAAAATGNSSQVSQNYPIVQNLQGQMIHQAISPRTLNAWVKVIEEKAFSPEVIPMFVALSEGSTPQDLNTMLNTVGGHQAAMQMLKETINEEAAEXDRTHPVHAGPVAPGQMREPRGSDIAGTTSTLQEQIAWMTSNPPVPVGEIYKKWIILGLNKIVRMYSPVSILDIRQGPKEPFRDYVDRFYKVLRAEQASQDVKNWMTETLIVQNANPDCKTILKALGPGATLEEMMTACQGVGGPGHKARVLAEAMSQVTNSTXIMMQNGNFRGQRKIVXCFNCGKEGHIAXNCKAPXKKGCWKCGKEGHQMKDCXERQANFLGKIWPSYKGRPGNFLQSRPEPTQSRLEPTAPPXESFRFGEETTPPQKQEKTDKELYPLTSLRSLFGSDPSSQ

SEQ ID NO: 526 - protein, 500 aa, Human immunodeficiency virus
  variant (55)..(55): Xaa can be any naturally occurring amino acid
  variant (85)..(85): Xaa can be any naturally occurring amino acid
  variant (94)..(94): Xaa can be any naturally occurring amino acid
  variant (105)..(105): Xaa can be any naturally occurring amino acid
  variant (116)..(116): Xaa can be any naturally occurring amino acid
  variant (235)..(235): Xaa can be any naturally occurring amino acid
  variant (460)..(460): Xaa can be any naturally occurring amino acid
MGARASVLSGGELDRWEKIRLRPGGKKKYKLKHIVWASRELERFAVNPGLLETSXGCRQILGQLQPALQTGSEELKSVYNTVATXYCVHQRIDXKDTKDALDKIXEEQNKSKKKAXQAAADTGNRSQVSQNYPIVRNLQGQMVHQALTPRTLNAWVKVVEEKAFSPEVIPMFSALSEGATPSDLNTMLNTVGGHQAAMQMLKETINEEAADWDRMHPVHAGPIAPGQMREPRGSXIAGTTSTLQEQIDWMTGNPPIPVGEIYKRWIILGLNKIVRMYSPSSILDIKQGPKEPFRDYVDRFYKTLRAEQASQEVKNWMTETLLVQNANPDCKTILKALGPAATLEEMMTACQGVGGPSHKARVLAEAMSQVTNSATIMMQKGNYRDQRRTVKCFNCGKEGHIAKNCRAPRKKGCWKCGREGHQMKDCTERQANFLGKIWPSHKGRPGNFLQSRPEPTAPPXESFRFGEETTTSPQKQEPRDEELYPSASLRSLFGNDPSSQ

SEQ ID NO: 527 - protein, 505 aa, Human immunodeficiency virus
MGARASVLSGGQLDKWEKIRLRPGGKKKYQLKHIVWASRELERFAVNPGLLETSKGCRQILEQLQPALRTGSEELKSVYNTVATLYCVHQGIDVRDTKEALDKIEEEQNKSKQKAQQAAADTGNSSQVSQNYPIVQNLQGQMVHQAISPRTLNAWVKVIEEKAFSPEVIPMFTALSEGATPQDLNTMLNTVGGHQAAMQMLKETINEEAAEWDRTHPVHAGPVAPGQMREPRGSDIAGTTSTLQEQIAWMTSNPAIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVQHSTAIMMQNGNFRGQKKSVKCFNCGKVGHIARNCRAPRKKGCWKCGKEGHQMKDCSERQANFLGKLWPSHKGRPGNFLQSRPEPTAPPAESFGFGEETTTPPQKQEPIDRDMNKDLYPPLASLRSLFGNDHSSQ

SEQ ID NO: 528 - protein, 499 aa, Human immunodeficiency virus
  variant (18)..(18): Xaa can be any naturally occurring amino acid
  variant (26)..(26): Xaa can be any naturally occurring amino acid
  variant (173)..(173): Xaa can be any naturally occurring amino acid
  variant (361)..(361): Xaa can be any naturally occurring amino acid
  variant (476)..(476): Xaa can be any naturally occurring amino acid
MGARASVLSGGKLDRWEXIRLRPGGXKRYKLKHLVWASRELERFAVNPGLLETSEGCRQILGQLQPSLQTGSEELRSLYNTVATLYCVHQGIEVKDTKEALDKVEEEQNKSKRTQQAAADTGNSSQVSQNYPIVQNLQGQMIYQSLSPRTLNAWVKVVEEKAFSPEVIPMFSXLSEGATPQDLNTMLNTVGGHQAAMQMLKETINEEAAEWDRLHPVHAGPVAPGQMREPRGSDIAGTTSTPQEQIGWMTSNPPIPVGEIYKRWIILGLNKIVRMYSPTSILDIRQGPKEPFRDYVDRFYKTLRAEQATAEVKNWMTETLLVQNANPDCKTILKALGPGASLEEMMTACQGVGGPGHKARXLAEAMSQMTNSNTIMMQGGNFRNQRKKIKCFNCGREGHVAKNCRAPRKKGCWKCGKEGHQMKDCTERQANFLGKIWPSSKGRPGNFPQSRLEPTAPPEESLSFREEKTTPSQKQXPIDKELYPLASLRSLFGNDPSST

SEQ ID NO: 529 - protein, 505 aa, Human immunodeficiency virus
  variant (24)..(24): Xaa can be any naturally occurring amino acid
  variant (28)..(28): Xaa can be any naturally occurring amino acid
  variant (30)..(30): Xaa can be any naturally occurring amino acid
  variant (58)..(58): Xaa can be any naturally occurring amino acid
  variant (114)..(114): Xaa can be any naturally occurring amino acid
  variant (138)..(138): Xaa can be any naturally occurring amino acid
  variant (232)..(232): Xaa can be any naturally occurring amino acid
  variant (411)..(411): Xaa can be any naturally occurring amino acid
  variant (416)..(416): Xaa can be any naturally occurring amino acid
  variant (440)..(440): Xaa can be any naturally occurring amino acid
  variant (449)..(449): Xaa can be any naturally occurring amino acid
  variant (468)..(468): Xaa can be any naturally occurring amino acid
MGARASVLSGGELDKWERIRLRPXGKKXYXLKHIVWASRELERFAVNPGLLETSAGCXQILGQLQPSLQTGSEELKSLYNTIATLYCVHQRIDVKDTKEALEKIEEEQNKSKKXAQQAAADTGNSSQGSGSQVSQNYXIVQNLQGQMVHQAISPRTLNAWVKVIEEKAFSPEVIPMFSALSEGATPQDLNTMLNTVGGHQAAMQMLKETINEEAAEWDRLHPVHAGPVAPGXMREPRGSDIAGTTSTLQEQIGWMTNNPPIPVGEIYKRWIILGLNKIVRMYSPVSILDIKQGPKEPFRDYVDRFYRTLRAEQASQEVKNWMTETLLVQNANPDCKTILKALGPAATLEEMMTACQGVGGPGHKARVLAEAMSQVTNSAAIMMQKGNFRNQRKTVKCFNCGKEGHIAKNCXAPRKXGCWKCGREGHQMKDCTERQANFLXKIWPSYKGXPGNFLQSRPEPTAPTAPPXESFRFGEEMTTPPQKQELIDKELYPSASLKSLFGNDP

SEQ ID NO: 530 - protein, 504 aa, Human immunodeficiency virus
  variant (45)..(45): Xaa can be any naturally occurring amino acid
  variant (88)..(88): Xaa can be any naturally occurring amino acid
  variant (103)..(103): Xaa can be any naturally occurring amino acid
  variant (106)..(106): Xaa can be any naturally occurring amino acid
  variant (121)..(121): Xaa can be any naturally occurring amino acid
  variant (351)..(351): Xaa can be any naturally occurring amino acid
  variant (380)..(380): Xaa can be any naturally occurring amino acid
  variant (486)..(486): Xaa can be any naturally occurring amino acid
MGARASILSGGELDRWEKIRLRPGGKKKYRLKHLVWASRELERFXVNPGLLETAEGCRQILGQLQPALQTGSEELKSVYNTVATLYCXHQKIDIKDTKEALDXIEXEQNKSKKKAQQAAAXTGNNSQVSQNYPIVQNLQGQMVHQALSPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPTSILDIRQGPKEPFRDYVDRFYKTLRAEQASQEVKNWMTETLLVQNANPDCKTILKALGPGATLEEMMTACXGVGGPSHKARVLAEAMSQATNSANIMMQXGNFKNQRKTVKCFNCGKEGHIARNCRAPRKKGCWKCGKEGHQMKDCVERQANFLGKIWPSHKGRPGNFLQSRPEPTAPPEESFRFGEETTTPSQKQSQKQEPIDKXLYPLTSLRSLFGNDPSSQ

SEQ ID NO: 531 - protein, 499 aa, Human immunodeficiency virus
  variant (220)..(220): Xaa can be any naturally occurring amino acid
  variant (348)..(348): Xaa can be any naturally occurring amino acid
  variant (351)..(351): Xaa can be any naturally occurring amino acid
  variant (353)..(353): Xaa can be any naturally occurring amino acid
  variant (358)..(358): Xaa can be any naturally occurring amino acid
  variant (361)..(361): Xaa can be any naturally occurring amino acid
  variant (372)..(372): Xaa can be any naturally occurring amino acid
MGARASVLSGGKLDNWERIRLRPGGSKRYKLKHIVWASRELERFAVNPGLMETAEGCQQILGQLQPALQTGSEELKSLYNTIAVLYCVHQRIDVRDTKEALDKIEEEQNKSKKKAQQATADAGTSSQVSQNYPIVQNLQGQMVHQAISPRTLNAWVKVIEEKAFSPEVIPMFSALSEGATPQDLNTMLNTVGGHQAAMQMLKETINEEAAEWDRMHPVQXGPVAPGQIREPRGSDIAGTTSTLQEQITWMTSNPPIPVGEVYKRWIILGLNKIVRMYSPVSILDIRQGPKEPFRDYVDRFYKTLRAEQASQDVKNWMTETLLVQNANPDCKTILKALGPAATLEEMMXACXGXGGPGXKAXVLAEAMSQVTXSATIMMQRGNFRNQRKIVKCFNCGKEGHIAKNCRAPRKKGCWKCGKEGHQMKDCIERQANFLGKIWPSNKGRPGNFLQSRPEPTAPPEESFRFGKETTTPSQKQESKEELYPLTSLRSLFGNDPSSQ

SEQ ID NO: 532 - protein, 506 aa, Human immunodeficiency virus
MGARASVLSGGELDRWEKIRLRPGGKKKYRLKHIVWASRELERFAVNPSLLETSEGCRQILRQLQPSLQTGSEELKSLYNTIATLYCVHQRIEVKDTKEALDKIEEEQNKSKKKAQQAAADMGNSSQASVSQASVSQNYPIVQNLQGQMVHQPLTPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIKQGPKEPFRDYVDRFYKTLRAEQASQEVKNWMTETLLVQNANPDCKTILKALGPAATLEEMMTACQGVGGPGHKARVLAEAMSQVTNSATIMMQKGNFRSQRKIVKCFNCGKEGHIARSCRAPRKRGCWKCGKEGHQMKDCTERQANFLGKIWPSHKGRPGNFLQSRPEPSAPPEESFGFGEEATPSQKQEPRDKETYPLASLRSLFGNDPSSQ

SEQ ID NO: 533 - protein, 504 aa, Human immunodeficiency virus
MGARASVLSGGELDRWEKIRLRPGGKKKYRLKHIVWASRELERFAVNPGLLETSEGCRQILGQLQPSLQTGSEELRSLYNTVATLYCVHQKIDVKDTKEALEKVEEEQNKSKKKAQQAAADTGNSSKVSQNYPIVQNLQGQMVHQAISPRTLNAWVKVVEEKAFSPEVIPMFAALSEGATPQDLNTMLNTVGGHQAAMQMLKETINEEAAEWDRLHPVHAGPVAPGQMREPRGSDIAGTTSTLQEQIGWMTNNPPTPVGEIYKRWIILGLNKIVRMYSPTCILDIKQGPKEPFRDYVDRFYKTLRAEQASQEVKNWMTETLLVQNSNPDCKTILKALGPAATLEEMMTACQGVGGPGHKARVLAEAMSQVTNSATIMMQKGNFRNQRKTVKCFNCGKEGHIARNCRAPRKRGCWKCGKEGHQMKDCTERQANFLGKIWPSHKGRPGNFLQSRPEPTAPPEESFRFGEETPTPSQKQEPLIDLDKELLYPLASLRSLFGNDPSSK

SEQ ID NO: 534 - protein, 504 aa, Human immunodeficiency virus
MGARASVLSGGELDRWEKIRLRPGGKKRYKLKHIVWASRELERFAVNPGLLETSEGCRQILGQLQPALQTGSEELKSLYNTVATLYCVHQRIDVKDTKEALDKIEEEQNKSKKKAQQAAADTGNSSQVSQNYPIVQNMQGQMVHQAISPRTLNAWVKVIEEKAFSPEVIPMFSALSEGATPQDLNTMLNTVGGHQAAMQMLKETINEEAAEWDRLHPVQAGPVAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQITTPPNIMMQRGNFRNQRKVVKCFNCGKEGHIAKNCRAPRKKGCWKCGKEGHQMKDCTERQANFLGKIWPSSKGRPGNFPQSRTEPTAPPAPPEESFRFGEETTTPPQKQEPPIDRELYPLASLRSLFGNDPSSQ

SEQ ID NO: 535 - protein, 502 aa, Human immunodeficiency virus
MGARASVLSGGELDRWEKIRLRPGGKKRYKLKHIVWASRELERFAVNPGLLETSGGCRQILGQLQPSLQTGSEELKSLYNTIAVLYCVHQRIEVKDTKEALDKIEEEQNKCKKKAQQAAAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRMHPVHAGPVAPGQMREPRGSDIAGTTSTLQEQVGWMTSNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPSHKARVLAEAMSQTTSAAAIMMQRGNFRNQRKPVKCFNCGKEGHIAKNCRAPRKRGCWKCGKEGHQMKDCTERQANFLGKIWPSHKGRPGNFLQSRPEPTAPPEESFRFGEETTTPPQKQEPRDKELYPLASLRSLFGNDPSSQ

SEQ ID NO: 536 - protein, 498 aa, Human immunodeficiency virus
  variant (359)..(359): Xaa can be any naturally occurring amino acid
MGARASVLSGGELDKWEKIRLRPGGKKKYRLKHIVWASRELERFAVNPGLLETSDGCRQILEQLQPSLQTGSEELRSLFNTIAVLFCVHQRIEVKDTKEALDKIEEIQNKSKKKAQQAAADTKNNSQVSQNYPIVQNMQGQMVHQPISPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMSACQGVGGPAHXARVLAEAMSQVTNPTAIMMQRGNFKNQRKIVKCFNCGKEGHIAKNCRAPRKKGCWKCGREGHQMKDCTERQANFLGKIWPSYKGRPGNFLQSRPEPTAPPEESFRFGEEITTQKQEPIDKEQYPLASLRSLFGNDPSSQ

SEQ ID NO: 537 - protein, 502 aa, Human immunodeficiency virus
  variant (440)..(440): Xaa can be any naturally occurring amino acid
MGARASVLSGEKLDRWEKIRLRPGGKKRYKLKHIVWASRELERFAVNPGLLETSEGCKQILEQLQPSLQTGSEELRSLFNTIATLYCVHQRIDVKDTKEALDKIEEEQNKSKKKAQQAAAAADPGKSSQVSQNYPIVQNLQGQMVHQALSPRTLNAWVKVIEEKAFSPEVIPMFSALSEGATPQDLNTMLNTVGGHQAAMQMLKETINEEAAEWDRLHPAQAGPVAPGQMRDPRGSDIAGTTSTLQEQIGWMTGNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVTNSGAIMMQKGNFRNQRKTVKCFNCGREGHIAKNCRAPRKKGCWKCGKEGHQMKDCTERQANFLGKIXPSHKGRPGNFLQSRPEPTAPPAESFRFGEETATSSQKQEPIDKELYPLASLKSLFGNDPSSQ

SEQ ID NO: 538 - protein, 500 aa, Human immunodeficiency virus
  variant (275)..(275): Xaa can be any naturally occurring amino acid
MGARASVLSAGELDKWEKIRLRPGGKKKYRLKHIVWASRELERFGLNPGLLETSEGCRQILAQLYPSLQTGSEELRSLYNTVATLYCVHQKIEVKDTKEALDKIEEEQNKSKQKAQPAAADTGNNSKVSQNYPIVQNLQGQMVHQPLSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVXMYSPTSILDIKQGPKEPFRDYVDRFYKTLRAEQASQDVKNWMTETLLVQNANPDCKTILKALGPAATLEEMMTACQGVGGPGHKARVLVEAMSQVTNSANIMMQRGNFRNQRKTVKCFNCGKEGHIARNCRAPRKKGCWKCGKEGHQMKDCTERQANFLGRIWPSPKGRPGNFLQSRPEPTAPPEESFRFGEETTTPPQKQEPIDKELYPLASLRSLFGNDPSSQ

SEQ ID NO: 539 - protein, 501 aa, Human immunodeficiency virus
MGARASVLSGGKLDRWEKIRLRPGGKKQYKLKHLVWASRELERFAVNPGLLETSEGCRQILRQLQPSLQTGSEELKSLYNLVATLYCVHQSIDVRDTKEALDKIEEEQKKEQQAAADTGNKSQVSQNYPIVQNLQGQMVHQALSPRTLNAWVKVVEEKAFSPEVIPMFSALSEGATPQDLNTMLNTVGGHQAAMQMLKETINEEAAEWDRLHPVQAGPVAPGQMRDPRGSDIAGTTSTLQEQIGWMTSNPPIPVGEIYKRWIIIGLNKIVRMYSPTSILDIRQGPKEPFRDYVDRFYKTLRAEQASQDVKNWMTETLLVQNANPDCKTILKALGPGATLEEMMTACQGVGGPSHKARVLAEAMSQVTNSASASIMAQRGNYGNQRKAIKCFNCGKEGHIARNCRAPRKKGCWKCGKEGHQMKDCAERQANFLGKIWPSHKGRPGNFLQSRPEPTAPPAPPEESFRFGEEKPTPSQKQEQTDKELYPLASLRSLFGNDPSSQ

SEQ ID NO: 540 - protein, 500 aa, Human immunodeficiency virus
  variant (63)..(63): Xaa can be any naturally occurring amino acid
  variant (84)..(84): Xaa can be any naturally occurring amino acid
  variant (147)..(147): Xaa can be any naturally occurring amino acid
  variant (293)..(293): Xaa can be any naturally occurring amino acid
  variant (310)..(310): Xaa can be any naturally occurring amino acid
  variant (351)..(351): Xaa can be any naturally occurring amino acid
MGARASVLSAGELDRWEKIRLRPGGKKQYKLKHIVWASRELERFAVNPGLMETSEGCRKILGXLQPSLQTGSEELRSLYNTIAXLYCVHQKIDVRDTKEALDKIEEEQNKSKTQQAAADTGNSNQVSQNYPIVQNVQGQMVHQPISXRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIAWMTNNPPIPVGDIYKRWIILGLNKIVRMYSPTSILDIKQGPKEPFRXYVDRFYKTLRAEQASQXVKNWMTETLLVQNANPDCKTILRALGPAATLEEMMTACQGXGGPSHKARVLAEAMSQVTNSTAIMMQKGNFRGQRKTIKCFNCGKEGHIAKNCRAPRRKGCWKCGKEGHQIKDCTERQANFLGKIWPSSKGGRPGNFLQSRPEPTAPPAESFSFGGEETTTPSQKQEPTNKELYPLASLRSLFGNDPSSQ

SEQ ID NO: 541 - protein, 500 aa, Human immunodeficiency virus
  variant (477)..(477): Xaa can be any naturally occurring amino acid
MGARASVLSGGELDRWEKIRLRPGGKKKYQLKHIVWASRELERFAVNPGLLETSEGCRQILAQLQPSIQTGSEELKSLYNTVATLYCVHQKIEIKDTKEALDKIEEEQNKSKKKVQQAAADTGNSSQVSQNYPIVQNIQGQMVHQALSPRTLNAWVKVIEEKAFSPEVIPMFSALSEGATPQDLNTMLNTVGGHQAAMQMLKETINEEAAEWDRLHPVQAGPVAPGQMREPRGSDIAGTTSNLQEQIGWMTGNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPSHKARILAEAMSQVTNSTAIMMQRGNHRNQRKTIKCFNCGKEGHLARNCRAPRKRGCWKCGQEGHQMKECPGRQANFLGKVWPSHKGRPGNFLQNRPEPTAPPEESFRFGEETTTLSQKQXPTDKEMYPLASLRSLFGNDPSSQ

SEQ ID NO: 542 - protein, 502 aa, Human immunodeficiency virus
  variant (18)..(18): Xaa can be any naturally occurring amino acid
  variant (187)..(187): Xaa can be any naturally occurring amino acid
  variant (375)..(375): Xaa can be any naturally occurring amino acid
  variant (390)..(390): Xaa can be any naturally occurring amino acid
MGARASVLSGGKLDKWEXIRLRPGGKKRYHLKHIVWASRELERFAVNPGLLETSEGCRQIIGQLQPSLQTGSEELKSLYNTIAVLYCVHQNIDVRDTKEALEKIEEEQNKSKKKAQQAAADTGNSSGSKVSQNYPIVQNLQGQMVHQAISPRTLNAWVKVVEEKAFSPEVIPMFSALSEGATPQDLXTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNSNPDCKTILKALGPAATLEEMMTACQGVGGPGHKARVLAEAMSQVTSXPTIMMQKGNFRNPKXTVKCFNCGREGHIAKHCRAPRKKGCWKCGKEGHQMKDCTERQANFLGKIWPSHKGRPGNFLQSRPEPTAPPEESFRFGEETTTPPQKQETINKDLYPLASLRSLFGNDPSSQ

SEQ ID NO: 543 - protein, 502 aa, Human immunodeficiency virus
  variant (15)..(15): Xaa can be any naturally occurring amino acid
  variant (20)..(20): Xaa can be any naturally occurring amino acid
  variant (25)..(25): Xaa can be any naturally occurring amino acid
  variant (30)..(30): Xaa can be any naturally occurring amino acid
  variant (61)..(61): Xaa can be any naturally occurring amino acid
  variant (74)..(74): Xaa can be any naturally occurring amino acid
  variant (95)..(95): Xaa can be any naturally occurring amino acid
  variant (102)..(102): Xaa can be any naturally occurring amino acid
  variant (123)..(123): Xaa can be any naturally occurring amino acid
  variant (492)..(492): Xaa can be any naturally occurring amino acid
  variant (500)..(500): Xaa can be any naturally occurring amino acid
MGARASVLSGGELDXWEKIXLRPGXKKQYXLKHIVWASRELERFALNPGLLETSEGCRQIXGQLQPALQTGTEXLRSLFNTVATLYCVHQKIDVXDTKEALXKIEEEQTKSKKKAQQAAADTXNSSQISQNYPIVQNLQGQMVHQAISPRTLNAWVKVIEEKAFSPEVIPMFTALSEGATPQDLNTMLNTVGGHQAAMQMLKETINDEAAEWDRIHPVHAGPVAPGQMREPRGSDIAGTTSTLQEQIAWMTSNPPVPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTNSNAVMMQRGNFRNQRRSVKCFNCGKEGHIAKNCRAPRKKGCWKCGKEGHQMKDCTERQANFLGRIWPSYKGRPGNFLQSRPEPSAPPAESFMFGEETTTPPQKQESKDRDKETYPLASLXSLFGNDPXSQ

SEQ ID NO: 544 - protein, 499 aa, Human immunodeficiency virus
MGARASVLSGGELDKWEKIRLRPGGKKRYQLKHIVWASRELERFAVNPGLLETSEGCRQIIAQLQPSLQTGSEELRSLFNTVATLYCVHQRIEVKDTKEALEKIEEEQNKCKKKAQQAAADTGSNSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGSTSTLQEQIAWMTNNPPVPVGEIYKRWIILGLNKIVRMYSPVSILDIRQGPKEPFRDYVDRFYKTLRAEQASQEVKNWMTETLLVQNSNPDCKTILKALGPAATLEEMMTACQGVGGPSHKARILAEAMSQVTNPAAIMMQRGNFKNQRKPVKCFNCGKDGHISRNCKAPRKKGCWKCGREGHQMKDCTERQANFLGKIWPSQKGRPGNFLQNRTVPTAPPEESLRFGEETTPSQKQEPVDKELYPLASLRSLFGNDPSSQ

SEQ ID NO: 545 - protein, 505 aa, Human immunodeficiency virus
  variant (211)..(211): Xaa can be any naturally occurring amino acid
  variant (254)..(254): Xaa can be any naturally occurring amino acid
  variant (287)..(287): Xaa can be any naturally occurring amino acid
  variant (303)..(303): Xaa can be any naturally occurring amino acid
  variant (305)..(305): Xaa can be any naturally occurring amino acid
  variant (323)..(323): Xaa can be any naturally occurring amino acid
MGARASVLSGGKLDRWEKIRLRPGGKKKYQLKHIVWASRELDRFALNPGLLETSEGCKQILEQLQPALKTGTEEIRSLYNTVATLYCVHQGIEVKDTKEALDKIEEEQNKSKKKAQQAAAAADAGNNSQVSRNYPIVQNIQGQMVHQPISPRTLNAWVKVVEEKAFSPEVIPMFSALAEGATPQDLNTMLNTVGGHQAAMQMLKETINEEXAEWDRLHPVQAGPVAPGQMREPRGSDIAGTTSTLQEQIGWMTXNPPIPVGEIYKRWIIMGLNKIVRMYSPTSILDXRQGPKEPFRDYVDRFXKXLRAEQASQDVKNWMTETXLVQNSNPDCKTILKALGPGATLEEMMTACQGVGGPGHKARVLAEAMSQVTNSATVMMQKSNFRNQRKSVKCFNCGKEGHIAKNCRAPRKRGCWKCGKEGHQMKDCTERQANFLGKIWPSHKGRPGNFLQRRPEPTAPPAPPEESFRFGEETTTPSQKQEQVDKEMYPLASLRSLFGNDPSSP

SEQ ID NO: 546 - protein, 502 aa, Human immunodeficiency virus
  variant (69)..(69): Xaa can be any naturally occurring amino acid
  variant (489)..(489): Xaa can be any naturally occurring amino acid
MGARASVLSGGKLDRWEKIRLRPGGKKRYRLKHIVWASRELERFAVNPGLLETSIGCKQILEQLQSALXTGSEELKSLYNLVATLYCVHQGIDVKDTKEALDKIEEEQNKSKKKVQQAAADTGNQVSQVSQNYPIVQNLQGQMVHQALSPRTLNAWVKVVEEKAFSPEVIPMFTALSEGATPQDLNTMLNTVGGHQAAMQILKETINEEAAEWDRLHPVHAGPIAPGQMREPRGSDIAGTTSTLQEQIGWMTHNPPIPVGDIYKRWIILGLNKIVRMYSPTSILDIRQGPKEPFRDYVDRFYKTLRAEQASQEVKNWMTETLLVQNANPDCKTLLKALGPAATLEEMMTACQGVGGPGHKARVLAEAMSQINSAATTVMMQRGNFKNQRRTVKCFNCGKEGHIAKNCRAPRKKGCWKCGKEGHQLKDCTERQANFLGKIWPSHKGRPGNFLQSRPEPSAPPEESFRFGEEKTTPSQKQEPMDKELYPLXSLRSLFGNDPSSQ

SEQ ID NO: 547 - protein, 506 aa, Human immunodeficiency virus
  variant (468)..(468): Xaa can be any naturally occurring amino acid
MGARASVLSGGDLDRWEKIRLRPGGKKKYKLKHIVWASRELERFAVNPGLLETSDGCKQILAQLQPSLQTGSEELKSLFNTIAVLYCVHQRIEIKDTKEALDKIEEEQNKSKKKAQQAAADTGNSSSQVSQNYPIVQNMQGQMVHQPLTPRTLNAWVKVIEEKNFSPEIIPMFTALSEGATPQDLNTMLNTVGGHQAAMQMLKETINEEAAEWDRSHPVHAGPIAPGQMREPRGSDIAGTTSNLQEQIGWMTNNPPIPVGEIYKRWIVLGLNKIVRMYSPTSILDIKQGPKEPFRDYVDRFYKTLRAEQASQEVKNWMTETLLVQNANPDCKTILRALGPAATLEEMMTACQGVGGPAHKARVLAEAMSQVTNSNTIMMQKGNFRGQRKPVKCFNCGKEGHIAKNCRAPRRRGCWKCGKEGHQMKDCTERQANFLGKIWPSNKGRPGNFLQSRPEPTAPPEESFRFGXEAATPSQKQEQLIDLDRDKELYPLTSLRSLFGSDPSSK

SEQ ID NO: 548 - protein, 509 aa, Human immunodeficiency virus
  variant (40)..(40): Xaa can be any naturally occurring amino acid
  variant (57)..(57): Xaa can be any naturally occurring amino acid
  variant (62)..(62): Xaa can be any naturally occurring amino acid
  variant (66)..(66): Xaa can be any naturally occurring amino acid
  variant (84)..(84): Xaa can be any naturally occurring amino acid
  variant (112)..(112): Xaa can be any naturally occurring amino acid
  variant (166)..(166): Xaa can be any naturally occurring amino acid
  variant (197)..(197): Xaa can be any naturally occurring amino acid
  variant (260)..(260): Xaa can be any naturally occurring amino acid
  variant (320)..(320): Xaa can be any naturally occurring amino acid
  variant (326)..(326): Xaa can be any naturally occurring amino acid
  variant (331)..(331): Xaa can be any naturally occurring amino acid
  variant (388)..(388): Xaa can be any naturally occurring amino acid
  variant (391)..(391): Xaa can be any naturally occurring amino acid
  variant (408)..(408): Xaa can be any naturally occurring amino acid
  variant (420)..(420): Xaa can be any naturally occurring amino acid
MGARASVLSGGELDKWEKIRLRPGGKKKYRLKHIVWASRXLERFAVNPGLLETSEGXRQILXQLQXSLQTGSEELRSLYNTIAXLYCVHQRIEVKDTKEALDKVEEEQNKSXKKAQQAAAGTGNNSQVSQNYPIVQNLQGQMVHQAISPRTLNAWVKVVEEKAFSXEVIPMFSALSEGATPQDLNTMLNTVGGHQAXMQMLKETINEEAAEWDRVHPVHAGPIAPGQMREPRGSDIAGTTSTLQEQIGWMTNNPPIPVGXIYKRWIILGLNKIVRMYSPTSILDIRQGPKEPFRDYVDRFYKTLRAEQASQEVKNWMTEXLLVQNXNPDCXTILKALGPAATLEEMMTACQGVGGPGHKARVLAEAMSQVNSSTMMMQRGNFRNQRKXVKXFNCGKEGHIAKNCRAPXKKGCWKCGKEGXQMKDCTERQANFLGKIWPSHKGRPGNFLQNRPEQNRPEPSRPEPSAPPEESFRFGEETATPPQKQETIDKELYPLTSLKSLFGNDPSSQ

SEQ ID NO: 549 - protein, 502 aa, Human immunodeficiency virus
  variant (124)..(124): Xaa can be any naturally occurring amino acid
  variant (246)..(246): Xaa can be any naturally occurring amino acid
  variant (389)..(389): Xaa can be any naturally occurring amino acid
  variant (444)..(444): Xaa can be any naturally occurring amino acid
  variant (475)..(475): Xaa can be any naturally occurring amino acid
  variant (481)..(481): Xaa can be any naturally occurring amino acid
  variant (494)..(494): Xaa can be any naturally occurring amino acid
  variant (502)..(502): Xaa can be any naturally occurring amino acid
MGARASVLSGGELDRWEKIRLRPGGKKKYKLKHIVWASRELERFAVNPGLLETSEGCRQILGQLQPSIRTGSEELKSLYNTVAVLYCVHQRIDVKDTKEALDKIEEEQNESKKKAQQAATAADXGNSNQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLXEQIGWMTNNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNSASMMMQRSNFKNQXKTVKCFNCGKEGHIAKNCRAPRKKGCWKCGKEGHQMKDCTERQAIFLGKIWPSHXGRPGNFLQSRPEPTAPPAESFMFGEETTTPXQKQEPXDQGLYPLASLKSXFGNDPSSX

SEQ ID NO: 550 - protein, 500 aa, Human immunodeficiency virus
  variant (21)..(21): Xaa can be any naturally occurring amino acid
  variant (55)..(55): Xaa can be any naturally occurring amino acid
  variant (88)..(88): Xaa can be any naturally occurring amino acid
  variant (111)..(111): Xaa can be any naturally occurring amino acid
  variant (120)..(120): Xaa can be any naturally occurring amino acid
  variant (131)..(131): Xaa can be any naturally occurring amino acid
  variant (138)..(138): Xaa can be any naturally occurring amino acid
  variant (184)..(184): Xaa can be any naturally occurring amino acid
  variant (258)..(258): Xaa can be any naturally occurring amino acid
  variant (275)..(275): Xaa can be any naturally occurring amino acid
  variant (284)..(284): Xaa can be any naturally occurring amino acid
  variant (292)..(292): Xaa can be any naturally occurring amino acid
  variant (312)..(312): Xaa can be any naturally occurring amino acid
  variant (341)..(341): Xaa can be any naturally occurring amino acid
  variant (371)..(371): Xaa can be any naturally occurring amino acid
  variant (453)..(453): Xaa can be any naturally occurring amino acid
  variant (477)..(477): Xaa can be any naturally occurring amino acid
MGARASVLSGGKLDKWEKIRXRPGGKKQYKLKHIVWASRELERFAVNPGLLETSXGCRQILEQLQPSLKTGSEELRSLFNTIATLWCXHRGIDVKDTKEALDKIEEEQNKXKKKAQQETXSTGNSSQVSQXYPIVRNXQGQMVHQAISPRTLNAWVKVVEEKAFSPEVIPMFAALSEGATPQDXNTMLNTVGGHQAAMQMLKETINEEAAEWDRLHPVHAGPIAPGQMREPRGSDIAGTTSTLEEQIAWITNNPPVPXGEIYKRWIILGLNKIVXMYSPTSILXIRQGPKEXFRDYVDRFYKTLRAEQASQXVKNWMTETLLVQNANPDCKTILKALGPAXTLEEMMTACQGVGGPGHKARVLAEAMSQVXNSTAIMMQRGNFRNQRKIVKCFNCGKEGHIAKNCRAPRKRGCWKCGKEGHQMKDCTERQANFLGKIWPSHKGRPGNFLQSRXEPTAPPEESFRFGEETTTPPQKQXQINKDMYPLASLRSLFGNDPSSQ

SEQ ID NO: 551 - protein, 500 aa, Human immunodeficiency virus
  variant (460)..(460): Xaa can be any naturally occurring amino acid
MGARASVLSGGELDRWERIRLRPGGRKRYQLKHIVWASRELERFAVNPGLLETSEGCRQILEQLQPSLPVGSEEIRSLYNTVAVLYCVHQRIEVKDTKEALDKIEEEQNKSKKKAQPTAAGAGSSSQASQNFPIVQNLQGQMVHQPISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKNIKCFNCGKEGHIAKNCRAPRRKGCWKCGKEGHQMKDCTERQANFLGKIWPSHKGRPGNFLQSRPEPTAPPXESFRFGEETTTPSQKQEPTDKELYPLASLKSLFGNDPSSQ

SEQ ID NO: 552 - protein, 509 aa, Human immunodeficiency virus
MGARASVLSGGKLDQWEKIRLRPGGKKTYKLKHIVWVSRELERFAVNPGLLETAEGCKQILEHLQPSLQTGSEELKSLYNAVAVLCCVHQRIDVKDTKEALDKIEEEQNKSKKKAQQAAKAQQEAADTGNSNQVSQNYPIVQNLQGQMVHQALSPRTLNAWVKVVEEKAFSPEVIPMFSALSEGATPADLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNSNTIMMQRGNFRNQRKTVKCFNCGKEGHIARNCRAPRKKGCWKCGKEGHQMKDCVERQANFLGKIWPSHKGRPGNFLQSRPEPTAPLEPTAPPEESFRFGEERATPSQKPEPIDKDRYPLASLRSLFGNDP

SEQ ID NO: 553 - protein, 507 aa, Human immunodeficiency virus
  variant (319)..(319): Xaa can be any naturally occurring amino acid
  variant (424)..(424): Xaa can be any naturally occurring amino acid
MGARASILSGGQLDRWEKIRLRPGGRKRYKLKHIVWASRELERFAVNPGLLETSDGCRQILGQLQPSLQTGSEELKSLYNTVAVLYCVHQRIEVKDTKEALEKIEEEQNKSKKKAQQAAAAAADTGNNSQVSQNYPIVQNMQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIIMGLNKIVKMYSPVSILDIRQGPKEPFRDYVDRFYKTLRAEQATQEVKNXMTETLLVQNANPDCKTILKALGPAATLEEMMAACQGVGGPSHKARVLAEAMSQVTNSATIMMQKGNFKNQRKIVKCFNCGKEGHIARNCRAPRRKGCWKCGKEGXQLKDCAERQANFLGKIWPSHKGRPGNFLQSRPEPTAPPEESFRFGEETTTPSQKQDPKQDPIDKEMYPLTSLRSLFGNDPSSQ

SEQ ID NO: 554 - protein, 505 aa, Human immunodeficiency virus
MGARASVLSGGELDRWEKIRLRPGGKKKYKLKHIVWASRELERFAVNPGLLETSEGCRQILGQLQPSLQTGSEELKSLYNTVAVLYCVHQRIEVKDTKEALDKIEEEQNKSKKKAQQAAADTGNNSTGNSSEVSRNFPIVQNLQGQMVHQAISPRTLNAWVKVVEEKAFSPEVIPMFSALSEGATPQDLNTMLNTVGGHQAAMQMLKETINEEAAEWDRLHPQQAGPIAPGQIREPRGSDIAGTTSTLQEQITWMTNNPPIPVGEIYKRWIILGLHKIVRMYSPSSILDIKQGPKEPFRDYVDRFYKTLRAEQATQEVKNWMTETLLVQNANPDCKTILKALGPAATLEEMMTACQGVGGPAHKARVLAEAMSHVTNSATIMMQKGNFRNQRKIVKCFNCGKEGHIARNCRAPRKKGCWKCGKEGHQMKDCTERQANFLGKIWPSHKGRPGNFLQSRPEPTAPPEESFRFGEGTAIPSQKQEPIDKELYPLTSLRSLFGNDHSSQ

SEQ ID NO: 555 - protein, 499 aa, Human immunodeficiency virus
  variant (40)..(40): Xaa can be any naturally occurring amino acid
  variant (76)..(76): Xaa can be any naturally occurring amino acid
  variant (92)..(92): Xaa can be any naturally occurring amino acid
  variant (123)..(123): Xaa can be any naturally occurring amino acid
  variant (126)..(126): Xaa can be any naturally occurring amino acid
  variant (146)..(146): Xaa can be any naturally occurring amino acid
  variant (202)..(202): Xaa can be any naturally occurring amino acid
  variant (302)..(302): Xaa can be any naturally occurring amino acid
  variant (364)..(364): Xaa can be any naturally occurring amino acid
  variant (450)..(450): Xaa can be any naturally occurring amino acid
  variant (471)..(471): Xaa can be any naturally occurring amino acid
MGARASVLSGGELDKWEKIRLRPGGKKKYRLKHIVWASRXLERFAVNPGLLETAEGCRQILGQLQPSLQTGSEELXSLYNTIAVLYCVHQRXEVKDTKEAVEKVEEEQNKSKKKAQAAADTKXSSXVSQNYPIVQNLQGQMVHQPXSPRTLNAWVKVVEEKAFSPEVIPMFTALSEGATPQDLNTMLNTVGGHQAAMQMLKXTINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKXLRAEQASQEVKNWMTETLLVQNANPDCRTILKALGPAATLEEMMTACQGVGGPAHKARVLAXAMSQVTNPTTIMMQRGNLRNQRKTVKCFNCGKEGHIAKNCRAPRKKGCWKCGKKGHQLKDCTERQANFLGKIWPSHKGRPGNFLQXRPEPTAPPEESFRFGEETTTXPQKQEPIDKELYPLASLRSLFGNDPSSQ

SEQ ID NO: 556 - protein, 489 aa, Human immunodeficiency virus
  variant (446)..(446): Xaa can be any naturally occurring amino acid
MGARASILSGGKLDKWEKIRLRPGGRKKYQLKHLVWASRELERFAVNPGLLETAEGCKQILQQLQPSLRTGSEELRSLYNAVATLYCVHQGIEVKDTKEALDKVEEEQNESKKQTQQAAAGTGNNSQVSQNYPIVQNLQGQMVHQALSPRTLNAWVKVIEEKAFSPEVIPMFTALSEGATPQDLNTMLNTVGGHQAAMQMLKDTINEEAAEWDRLHPVHAGPNAPGQLREPRGSDIAGTTSTLQEQIAWMTHNPPIPVGDIYKRWIILGLNKIVRMYSPVSILDIRQGPKEPFRDYVDRFYKTLRAEQASQDVKNWMTETLLVQNANPDCRTILKALGPAATLEEMMTACQGVGGPGHKARVLAEAMSQVTNSATVMMQKGNLGNQRKFVKCFNCGKAGHISRNCRAPRKKGCWKCGKEGHQMKDCTERQANFLGNFPQSRTEPTXPPEESFRFGEETTPSQKQEKTDKEELYPLASLRSLFGNDPSSQ

SEQ ID NO: 557 - protein, 512 aa, Human immunodeficiency virus
  variant (46)..(46): Xaa can be any naturally occurring amino acid
  variant (74)..(74): Xaa can be any naturally occurring amino acid
  variant (90)..(90): Xaa can be any naturally occurring amino acid
  variant (93)..(93): Xaa can be any naturally occurring amino acid
  variant (109)..(109): Xaa can be any naturally occurring amino acid
  variant (124)..(124): Xaa can be any naturally occurring amino acid
  variant (127)..(127): Xaa can be any naturally occurring amino acid
  variant (168)..(168): Xaa can be any naturally occurring amino acid
  variant (179)..(179): Xaa can be any naturally occurring amino acid
  variant (201)..(201): Xaa can be any naturally occurring amino acid
  variant (264)..(264): Xaa can be any naturally occurring amino acid
  variant (273)..(273): Xaa can be any naturally occurring amino acid
  variant (284)..(284): Xaa can be any naturally occurring amino acid
  variant (392)..(392): Xaa can be any naturally occurring amino acid
  variant (466)..(466): Xaa can be any naturally occurring amino acid
  variant (490)..(490): Xaa can be any naturally occurring amino acid
MGARASVLSGGELDRWEKIRLRPGGKKKYRLKHIVWASRELERFAXNPGLLETSGGCRQILIQLQPSLQTGSEXLKSLYNTVATLYCVHXKIXVRDTKEALEKVEEEQXKSKKKAQQAAADTGXNSXNSSQVSQNYPIVQNMQGQMVHQAISPRTLNAWVKVVEEKAXSPEVIPMFSAXSEGATPQDLNTMLNTVGGHQAXMQMLKETINEEAAEWDRLHPVHAGPIAPGQMREPRGSDIAGTTSTLQEQIGWMTHNPPIPVGXIYKRWIILXLNKIVRMYSPXSILDIRQGPKEPFRDYVDRFYKTLRAEQASQEVKNWMTETLLVQNANPDCKTILKALGPAATLEEMMTACQGVGGPGHKARVLAEAMSQATNSAAIMMQRGNFRNQRXTIKCFNCGKEGHLARNCRAPRKKGCWKCGKEGHQMKDCTERQANFLGKIWPSHKGRPGNFLQSRPEPTAPPRPXPTAPPEESFRFGEETATPAQKQEXKDKELYPLASLRSLFGSDPSLQ

SEQ ID NO: 558 - protein, 501 aa, Human immunodeficiency virus
  variant (11)..(11): Xaa can be any naturally occurring amino acid
  variant (164)..(164): Xaa can be any naturally occurring amino acid
  variant (183)..(183): Xaa can be any naturally occurring amino acid
  variant (195)..(195): Xaa can be any naturally occurring amino acid
  variant (459)..(459): Xaa can be any naturally occurring amino acid
  variant (475)..(475): Xaa can be any naturally occurring amino acid
  variant (493)..(493): Xaa can be any naturally occurring amino acid
MGARASILSGXKLDAWEKIRLRPGGKKQYQLKHIVWASRELERFAVNPGLLETSEGCRQILQQLQPSLQTGSEELKSLYNTIAVLYCVHQRIDVKDTKEALDKIEEEQNKSKKQAQQAAANTGNSSQVSQNYPIVQNLQGQMVHQSLSPRTLNAWVKVIEEKAXSPEVIPMFTALSEGATPQXLNTMLNTVGGHXAAMQMLKETINEEAAEWDRLHPVHAGPVAPGQMREPRGSDIAGTTSTLQEQIGWMTSNPAIPVGEIYKRWIILGLNKIVRMYSPISILDIKQGPKEPFRDYVDRFYKTLRAEQASQDVKNWMTETLLVQNSNPDCKTILKALGPGATLEEMMTACQGVGGPSHKARILAEAMSQVNSTAVMMQRGNFRNQRKTVKCFNCGKEGHIARNCRAPRKKGCWRCGKEGHQMKDCTERQANFLGKFWPSHKGRPGNFLQSRPEPSAPPXESFRFGEETTTPPQKXELIDLDKELYPSASLKSXFGNDPSSK

SEQ ID NO: 559 - protein, 504 aa, Human immunodeficiency virus
  variant (247)..(247): Xaa can be any naturally occurring amino acid
  variant (249)..(249): Xaa can be any naturally occurring amino acid
  variant (287)..(287): Xaa can be any naturally occurring amino acid
  variant (407)..(407): Xaa can be any naturally occurring amino acid
  variant (456)..(456): Xaa can be any naturally occurring amino acid
  variant (477)..(477): Xaa can be any naturally occurring amino acid
  variant (489)..(489): Xaa can be any naturally occurring amino acid
  variant (501)..(501): Xaa can be any naturally occurring amino acid
MGARASVISGGELDRWEKIRLRPGGHKKYRLKHIVWASRELERFAVNPGLLETGAGCRQILEQLQPSLQTGSEELKSLYNTIAVLYCVHQRIDVKDTKEALDKIEEEQNKSKKKVQQAAAATAADTGSNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTXQXQIGWMTNNPPIPVGEIYKRWIILGLNKIVRMYSPTSIXDIRQGPKEPFRDYVDRFYKTLRAEQASQEVKNWMTETLLVQNANPDCKTILKALGPAATLEEMMTACQGVGGPGHKARILAEAMSQVTNPATIMMQRGNFRGQGRPVKCFNCGKEGHIAXNCKAPRKKGCWKCGKEGHQMKDCNERQANFLGKIWPSSKGRPGNFLQSXPEPTAPPMESFKFGEETTTPXQKQEPTDKEMYXLASLKSLFGNDXSSQ

SEQ ID NO: 560 - protein, 498 aa, Human immunodeficiency virus
  variant (17)..(17): Xaa can be any naturally occurring amino acid
  variant (62)..(62): Xaa can be any naturally occurring amino acid
  variant (104)..(104): Xaa can be any naturally occurring amino acid
  variant (138)..(138): Xaa can be any naturally occurring amino acid
  variant (143)..(143): Xaa can be any naturally occurring amino acid
  variant (173)..(173): Xaa can be any naturally occurring amino acid
  variant (240)..(240): Xaa can be any naturally occurring amino acid
  variant (258)..(258): Xaa can be any naturally occurring amino acid
  variant (277)..(277): Xaa can be any naturally occurring amino acid
  variant (285)..(285): Xaa can be any naturally occurring amino acid
  variant (307)..(307): Xaa can be any naturally occurring amino acid
  variant (326)..(326): Xaa can be any naturally occurring amino acid
  variant (387)..(387): Xaa can be any naturally occurring amino acid
  variant (430)..(430): Xaa can be any naturally occurring amino acid
  variant (463)..(463): Xaa can be any naturally occurring amino acid
  variant (474)..(474): Xaa can be any naturally occurring amino acid
MGARASVLSGGDLDRWXKIRLRPGGKKRYQLKHIVWASRELERFAVNPGLLETAEGCRQILXQLQPSLQTGSEELKSLYNAVATLYCVHQKIDVKDTKEALDIXEEEQNKGKKKAQQAAADTGNSGQVSQNYPIVQNXQGQMXHQAIAPRTLNAWVKVVEEKAFSPEVIPMFXALSEGATPQDLNTMLNTVGGHQAAMQMLKETINEEAAEWDRLHPVQAGPVAPGQMREPRGSDIAGTXSTLQEQIGWMTSNPPIPXGEIYKRWIVMGLNKIVRMXSPTSILDXRQGPKEPFRDYVDRFYKTLRAXQASQDVKNWMTETLLVQNXNPDCKTILKALGPGATLEEMMTACQGVGGPGHKARVLAEAMSQVNPNAIMMQRGNFRNQRXTVKCFNCGKEGHIAKNCRAPRKKGCWKCGQEGHQMKDCTERQXNFLGKIWPSHKGRPGNFPQSRTEPTAPPEESFXFGEETTPPQKXGQKDKELYPLTSLRSLFGNDPSSQ

SEQ ID NO: 561 - protein, 503 aa, Human immunodeficiency virus
  variant (114)..(114): Xaa can be any naturally occurring amino acid
  variant (202)..(202): Xaa can be any naturally occurring amino acid
  variant (326)..(326): Xaa can be any naturally occurring amino acid
  variant (351)..(351): Xaa can be any naturally occurring amino acid
  variant (503)..(503): Xaa can be any naturally occurring amino acid
MGARASVLRGGDLDRWEKIRLRPGGKKTYQLKHIVWASRELERFAVNPGLLETAEGCRLILGQLQPSLQTGSEELRSLYNTIAVLYCVHQKIDVKDTKEALDKIEEEQNKSKKXAQQAQQTEAATGNNSQVSQNYPIVQNLQGQMVHQALSPRTLNAWVKVVEEKAFSPEVIPMFSALSEGATPQDLNTMLNTVGGHQAAMXMLKETINEEAAEWDRMHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQDVKNWMTETLLXQNANPDCKTILKAMGPGVTLEEMMXACQGVGGPGHKARVLAEAMSQVTNSTNIMMQRGNFRKTVKCFNCGKQGHIARNCRAPRKKGCWKCGKEGHQMKDCTERQANFLGKIWPSHKGRPGNFLQSRPEPTVPTAPPAESFRFGEETTTPPQKQEQIDKDPSPLASLRSLFGNDPSSX

SEQ ID NO: 562 - protein, 506 aa, Human immunodeficiency virus
  variant (177)..(177): Xaa can be any naturally occurring amino acid
  variant (389)..(389): Xaa can be any naturally occurring amino acid
  variant (392)..(392): Xaa can be any naturally occurring amino acid
  variant (395)..(395): Xaa can be any naturally occurring amino acid
  variant (405)..(405): Xaa can be any naturally occurring amino acid
  variant (416)..(416): Xaa can be any naturally occurring amino acid
MGARASVLSGGKLDKWERIRLRPGGKKKYRLKHIVWASRELERFAVNPGLLETSEGCRQILGQLYPALNTGSEELRSLYNTVATLYCVHKEIEVKDTKEALDKIEEEQNTNKKKEQQAAADTGNRSQVSQNYPIVQNLQGQMVHQALSPRTLNAWVKVIEEKAFSPEVIPMFTALSXGATPQDLNTMLNTVGGHQAAMQMLKETINEEAAEWDRLHPVPAGPVAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILRALGPAATLEEMMIACQGVGGPGHKARVLAEAMSQVTNSATVMMQRGNFRDPRKXVKXFNXGKTGHIAKNXRAPRKKGCWKXGKEGHQMKDCNERQANFLGRVWPFHKERPGNFLQSRPAPTAPTEPTAPPEESFRFGEGTATPPQKQEPIDKDLYPLASLKSLFGNDPLSQ

SEQ ID NO: 563 - protein, 504 aa, Human immunodeficiency virus
  variant (46)..(46): Xaa can be any naturally occurring amino acid
  variant (62)..(62): Xaa can be any naturally occurring amino acid
  variant (211)..(211): Xaa can be any naturally occurring amino acid
  variant (410)..(410): Xaa can be any naturally occurring amino acid
  variant (482)..(482): Xaa can be any naturally occurring amino acid
MGARASVLSGGELDRWEKIRLRPGGKKQYKLKHIVWASRELERFAXNPGLLETSEGCRQILXQLQPSLQTGSEELKSLFNTVATLYCVHQRIPVKDTKEALDKVEEEQNKSKKKAQQQAAAGTGNSSQVSQVSQNYPIVQNLQGQMVHQALSPRTLNAWVKVVEEKAFSPEVIPMFSALSEGATPQDLNTMLNTVGGHQAAMQMLKETINXEAAEWDRLHPVQAGPVAPGQIREPRGSDIAGTTSTLQEQIAWMTHNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNAGNIMMQRGNFKNQRKTIKCFNCGKEGHLARNCXAPRKKGCWKCGKEGHQMKDCTERQANFLGKIWPSHKGRPGNFLQSRPEPSAPPEESFRFGEETTTPSQKQEXIDKEVYPLTSLKSLFGNDPSSQ

SEQ ID NO: 564 - protein, 499 aa, Human immunodeficiency virus
  variant (227)..(227): Xaa can be any naturally occurring amino acid
  variant (307)..(307): Xaa can be any naturally occurring amino acid
  variant (460)..(460): Xaa can be any naturally occurring amino acid
MGARASVLSGGDLDRWEKIQLRPGGKKKYKLKHIVWASRELERFAVNPGLLETSEGCRKILEQLQPALRTGSEELRSLYNTVATLYCVHQKIEVKDTKEALDKIEEEQNKSKKNAQQAAADTGNRSQVSQNYPIVQNLQGQMVHQAISPRTLNAWVKVVEEKAFSPEVIPMFSALSEGATPQDLNTMLNTVGGHQAAMQMLKETINEEAAEWDRLHPVQAGPVAPGXMREPRGSDIAGTTSNLQEQIGWMTSNPPIPVGEIYKRWIILGLNKIVRMYSPTSILDIRQGPKEPFRDYVDRFYKTLRAXQASQDVKNWMTETLLVQNANPDCKTILKALGPAATLEEMMTACQGVGGPGHKARVLAEAMSQVTNSATIMMQRGSFRNQRRIVKCFNCGKEGHIAKNCRAPRKKGCWKCGKEGHQMKDCTERQANFLGKIWPSHKGRPGNFLQSRPEPTAPPXESFRFGKETTPPQKQESIDKELYPLASLKSLFGNDPSSQ

SEQ ID NO: 565 - protein, 500 aa, Human immunodeficiency virus
  variant (120)..(120): Xaa can be any naturally occurring amino acid
  variant (384)..(384): Xaa can be any naturally occurring amino acid
  variant (458)..(458): Xaa can be any naturally occurring amino acid
MGARASVLSGGELDRWEKIRLRPGGKKQYKLKHIVWASRELERFAVNPGLLETAEGCKQILGQLQPALPTGSEEIKSLYNTVATLYCVHQKIDVKDTKEALDRIEEEQNKCKKKAQQAAXDAEKSNQVSQNYPIVQNIQGQPVHQAISPRTLNAWVKVVEEKAFSPEVIPMFSALSEGATPQDLNTMLNTVGGHQAAMQMLKETINEEAAEWDRLHPAQAGPVAPGQMREPRGSDIAGTTSTLQEQIGWMTSNPPIPVGEIYKRWIILGLNKIVRMYSPSSILDIKQGPKEPFRDYVDRFYKTLRAEQASQEVKNWMTETLLVQNSNPDCKTILKALGPAATLEEMMTACQGVGGPGHKARVLAEAMSQVTNSATVMMQRGNFXNQKKTVKCFNCGKEGHLAKNCRAPRKRGCWKCGKEGHQMKDCTERQANFLGKIWPSHRGRPGNFLQSRPEPSAXPEESFRFGEETTAPSQKQEPIDKDLYPLASLRSLFGNDPSSQ

SEQ ID NO: 566 - protein, 508 aa, Human immunodeficiency virus
  variant (27)..(27): Xaa can be any naturally occurring amino acid
  variant (41)..(41): Xaa can be any naturally occurring amino acid
  variant (89)..(89): Xaa can be any naturally occurring amino acid
  variant (98)..(98): Xaa can be any naturally occurring amino acid
  variant (102)..(102): Xaa can be any naturally occurring amino acid
  variant (128)..(128): Xaa can be any naturally occurring amino acid
  variant (178)..(178): Xaa can be any naturally occurring amino acid
  variant (410)..(410): Xaa can be any naturally occurring amino acid
  variant (483)..(483): Xaa can be any naturally occurring amino acid
MGARASVLSGGKLDRWEKIRLRPGGKXRYKLKHIVWASREXERFAVNPGLLETSEGCRQILGQLQPALQTGSEELKSLYNTVATLYCVXQGIEVKDTXEALXKIEEEQNKSKKKAQQAAADTGSCSQXSQNYPIVQNIQGQMVHQALSPRTLNAWVKVIEEKAFSPEVIPMFSALSEXATPQDLNTMLNTVGGHQAAMQMLKETINEEAAEWDRLHPAQAGPVAPGQMRDPRGSDIAGTTSTLQEQIGWMTSNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQATNSATMMMQRGNFKNPGKNIKCFNCGKQGHTAKNCRAPRXKGCWKCGKEGHQMKDCTERQANFLGKIWPAHKGRPGNFLQSRPDPTAPSRTEPTAPPEESFKCREEITTPPQXQEPIDQGQYPLTSLRSLFGNDPSSQ

SEQ ID NO: 567 - protein, 500 aa, Human immunodeficiency virus
MGARASVLSGGELDRWEKIRLRPGGKKQYRLKHIVWASRELERFAVNPGLLETSEGCRQILSQLQPSLQTGSEELRSLYNTIATLYCVHQKIEVRDTKEALDKIEEEQNKSKKKAQPAAAATGNSSQDSQNYPIVQNLQGQMVHQPISARTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGDIYKRWIILGLNKIVRMYSPVSILDIRQGPKEPFRDYVDRFYKVLRAEQASQDVKNWMTETLLVQNANPDCKTILKALGPAATLEEMMTACQGVGGPGHKARVLAEAMSQVTNSATVMMQKGNFRNQRKTIKCFNCGKEGHLARNCRAPRKKGCWKCGREGHQMKDCTERQANFLGKLWPSQQGRPGNFLQSRPEPSAPPAESFRFGEETTTPSQKQGPIDEGKYPLASLRSLFGNDPSSQ

SEQ ID NO: 568 - protein, 502 aa, Human immunodeficiency virus
  variant (16)..(16): Xaa can be any naturally occurring amino acid
MGARASVLSGGKLDQXEKIRLRPGGKKKYKLKHIVWASRELERFALNPGLLETPEGCRQILGQIQPSLNTGTEELRSLYNTVAVLYCVHQRINVKDTKEALDKIEEEQNKSKQKTQQAAADTGSSSSSQVSQNYPIVQNLQGQMVHQALSPRTLNAWVKVIEEKAFSPEVIPMFTALSEGATPQDLNTMLNTVGGHQAAMQMLKETINEEAAEWDRLHPMQAGPVAPGQIRDPRGSDIAGTTSTLQEQIAWMTSNPPVPVGEIYKRWIILGLNKIVRMYSPVSILDIRQGPKEPFRDYVDRFYKTLRAEQASQDVKNWMTETLLVQNANPDCKTILKALGPAASLEEMMTACQGVGGPGHKARVLAEAMSQVTTPPTIMMQRGNFRNQRRTIKCFNCGREGHVAKNCRAPRKKGCWKCGKEGHQMKDCTERQANFLGKIWPSHKGRPGNFLQSRPEPTAPPAESFRSGEETAIPSQKQDQIDKELYPLASLRSLFGNDPSSQ

SEQ ID NO: 569 - protein, 500 aa, Human immunodeficiency virus
  variant (12)..(12): Xaa can be any naturally occurring amino acid
  variant (82)..(82): Xaa can be any naturally occurring amino acid
  variant (91)..(91): Xaa can be any naturally occurring amino acid
  variant (97)..(97): Xaa can be any naturally occurring amino acid
  variant (382)..(382): Xaa can be any naturally occurring amino acid
  variant (482)..(483): Xaa can be any naturally occurring amino acid
MGARASVLSGGXLDKWEKIRLRPGGKKKYKLKHIVWASRELERFAVNPGLMETAEGCKQILGQLQPSLQTGSEELKSLFNTXAVLYCVHQXIDVKDXKEALEKIEEEQTKSKKKVQQVAADTGNSSQVSQNYPIVQNMQGQMVHQAISPRTLNAWVKVIEEKAFSPEVIPMFAALSEGATPQDLNTMLNTVGGHQAAMQMLKETINEEAAEWDRLHPVHAGPIAPGQMREPRGSDIAGTTSTLQEQIGWMTNNPPIQVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPSHKARVLAEAMSQATNSATIMMQRGXFRNQRKIVKCFNCGKEGHIAKNCKAPRRKGCWKCGKEGHQMRDCTERQANFLGKIWPSHKGRPGNFLQSRPEPTAPPAESFGFGEETTTPSQKQEPTDKXXYPLASLRSLFGNDPLSQ

SEQ ID NO: 570 - protein, 498 aa, Human immunodeficiency virus
MGARASVLSGGELDKWEKIRLRPGGKKAYKLKHIVWASRELERFALNPGLLESAEGCRQILGQLQPSLRTGSEELRSLYNTVATLYCVHQKIAVKDTKEALDKVEEEQNKSKKKEAAADTGNSSQVSQNLPIVQNLQGQMVHQALSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIAWMTNNPAIPVGEIYKRWIILGLNKIVRMYSPVSILDIRQGPKEPFRDYVDRFYKTLRAEQATQEVKNWMTETLLVQNANPDCKTILKALGPGATLEDMMTACQGVGGPGHKARVLAEAMSQVTNSSAIMMQRGNFRNQRKTVKCFNCGKEGHIAKNCRAPRKKGCWKCGKEGHQMKDCTERQANFLGRIWPSHKGRPGNFLQSRPEPSAPPEESFRFGEETATPSQKQEPIDKELYPLTSLKSLFGNDPLSQ

SEQ ID NO: 571 - protein, 499 aa, Human immunodeficiency virus
  variant (437)..(437): Xaa can be any naturally occurring amino acid
  variant (446)..(446): Xaa can be any naturally occurring amino acid
MGARASILSGGKLDKWEKIRLRPGGKKQYKLKHLVWASRELERFAVNPGLLETSEGCRQILGQLQPSLQTGSEELKSLYNTIAVLYCVHQRIDINDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAADWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQANTASMMMQRSNFKNQGKTVKCFNCGKVGHIARNCRAPRKRGCWKCGKEGHQMKDCTERQANFLGKIXPSHKGRPGXFLQSRPEPTAPPEESFRFGEEATAPHQKQEPIDKELYPLASLKSLFGNDPSSQ

SEQ ID NO: 572 - protein, 504 aa, Human immunodeficiency virus
  variant (79)..(79): Xaa can be any naturally occurring amino acid
  variant (97)..(97): Xaa can be any naturally occurring amino acid
  variant (103)..(103): Xaa can be any naturally occurring amino acid
  variant (114)..(114): Xaa can be any naturally occurring amino acid
  variant (166)..(166): Xaa can be any naturally occurring amino acid
  variant (397)..(397): Xaa can be any naturally occurring amino acid
  variant (467)..(467): Xaa can be any naturally occurring amino acid
  variant (477)..(477): Xaa can be any naturally occurring amino acid
  variant (504)..(504): Xaa can be any naturally occurring amino acid
MGARASVLSAGELDKWEKIRLRPGGKKQYRLKHVVWASRELERFAVNPGLLETSEGCRQILGQLQPSLQTGSEELRSLXNTVAVLYCVHQKIDVKDXKEALDXVEEEQNQSKKXAQQAAAGTGNSNQASQNYPIVQNLQGQMVHQAISPRTLNAWVKVVEEKAFSXEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNTTAMMMQRGNFRNQRRTVKCFNCGXEGHIARNCRAPRKKGCWKCGKEGHQMKDCTNERQANFLGKIWPSHKGRPGNFPQSRTEPQSRLEPTAPPXESFRFGEEAXAPSQKQEPIDKDLYPLASLKSLFGNDX

SEQ ID NO: 573 - protein, 498 aa, Human immunodeficiency virus
  variant (3)..(3): Xaa can be any naturally occurring amino acid
  variant (15)..(15): Xaa can be any naturally occurring amino acid
  variant (81)..(81): Xaa can be any naturally occurring amino acid
  variant (114)..(114): Xaa can be any naturally occurring amino acid
  variant (193)..(193): Xaa can be any naturally occurring amino acid
  variant (280)..(280): Xaa can be any naturally occurring amino acid
  variant (304)..(304): Xaa can be any naturally occurring amino acid
  variant (334)..(334): Xaa can be any naturally occurring amino acid
  variant (485)..(485): Xaa can be any naturally occurring amino acid
MGXRASVLSGGELDXWEKIRLRPGGKKKYKLKHIVWASRELERFAVNPGLLETAEGCRQILGQLQPALQTGSEELKSLFNXVAVLFCVHRRIDVKDTKEALEKIEEEQNKSKKXAQQAAADTGNNSQVSQNYPIVQNMQGQMVHQAISPRTLNAWVKVVEEKAFSPEVIPMFSALSEGATPQDLNTMLNTVGXHQAAMQMLKETINEEAAEWDRLHPVHAGPIAPGQMREPRGSDIAGTTSTLQEQIGWMTNNPPIPVGEIYKRWIILGLNKIVRMYSPXSILDIKQGPKEPFRDYVDRFYKVXRAEQASQEVKNWMTETLLVQNANPDCKTIXKALGPAATLEEMMTACQGVGGPGHKARVLAEAMSQVTNSATIMMQKGNFKNQRKMVKCFNCGREGHIAKNCRAPRKKGCWKCGKEGHQMKDCTERQANFLGKIWPSHKGRPGNFLQSRPEPTAPPEESFREETTTPSQKPELIEKEKYPLXSLRSLFGNDPSSQ

SEQ ID NO: 574 - protein, 513 aa, Human immunodeficiency virus
  variant (15)..(15): Xaa can be any naturally occurring amino acid
  variant (47)..(47): Xaa can be any naturally occurring amino acid
  variant (103)..(103): Xaa can be any naturally occurring amino acid
  variant (172)..(172): Xaa can be any naturally occurring amino acid
  variant (376)..(376): Xaa can be any naturally occurring amino acid
  variant (380)..(380): Xaa can be any naturally occurring amino acid
  variant (392)..(392): Xaa can be any naturally occurring amino acid
MGARASVLSGGKLDXWEKIRLRPGGKKKYKLKHIVWASRELERFAVXPGLLETSEGCRQILGQLQPSLQTGSEELKSLYNTIAVLYCVHQRIEIKDTKEALDXIEEERNKSKKQAQQQQTQQAAADTGNSSKVSQNYPIVQNMQGQMVHQAISPRTLNAWVKVVEEKAFSPXVIPMFAALSEGATPQDLNTMLNTVGGHQAAMQMLKETINEEAAEWDRLHPVPAGPVAPGQMRDPRGSDIAGTTSTLQEQIGWMTSNPPIQVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPSHKARVLAEAMSQAXSAAXMMQRGNFRNQRXIVKCFNCGKEGHIARNCKAPRKKGCWKCGKEGHQMKDCNNERQANFLGKIWPSHKGRPGNFLQNRPEPTAPSRPEPTAPPEESFRFGEEIATPSQKQEPIDKGLYPLASLRSLFGNDPLSQ

SEQ ID NO: 575 - protein, 500 aa, Human immunodeficiency virus
  variant (40)..(40): Xaa can be any naturally occurring amino acid
  variant (68)..(68): Xaa can be any naturally occurring amino acid
  variant (77)..(77): Xaa can be any naturally occurring amino acid
  variant (357)..(357): Xaa can be any naturally occurring amino acid
  variant (370)..(370): Xaa can be any naturally occurring amino acid
  variant (374)..(374): Xaa can be any naturally occurring amino acid
  variant (392)..(392): Xaa can be any naturally occurring amino acid
  variant (402)..(402): Xaa can be any naturally occurring amino acid
  variant (421)..(421): Xaa can be any naturally occurring amino acid
  variant (471)..(471): Xaa can be any naturally occurring amino acid
MGARASVLSGGKLDKWERIRLRPGGKKKYKLKHIVWASRXLERFALNPGLLETSEGCRQILGQIQPSXQTGSEEIKXLYNTVATLYCVHQNIEIRDTKEALEKIEEEQNKSKKKAQQAAADTGSSKQVSQNYPIVQNIQGQMVHQAISPRTLNAWVKVVEEKAFSPEVIPMFSALSEGATPQDLNTMLNTVGGHQAAMQMLKETINEEAAEWDRVHPVQAGPIAPGQIREPRGSDIAGTTSTLQEQITWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPXHKARVLAEAMSQXTNPXNIMMQRGNFKNQRKAVKXFNCGKEGHIXKNCRAPRKRGCWKCGKEGXQMKDCTERQANFLGKIWPSHKGRPGNFLQNRPEPTAPPEESFRFGEEATXPSQKQESIDKDLYPLASLKSLFGNDPSSQ

SEQ ID NO: 576 - protein, 504 aa, Human immunodeficiency virus
  variant (26)..(26): Xaa can be any naturally occurring amino acid
  variant (28)..(28): Xaa can be any naturally occurring amino acid
  variant (43)..(43): Xaa can be any naturally occurring amino acid
  variant (54)..(54): Xaa can be any naturally occurring amino acid
  variant (63)..(63): Xaa can be any naturally occurring amino acid
  variant (114)..(114): Xaa can be any naturally occurring amino acid
  variant (138)..(138): Xaa can be any naturally occurring amino acid
  variant (164)..(164): Xaa can be any naturally occurring amino acid
  variant (309)..(309): Xaa can be any naturally occurring amino acid
  variant (329)..(329): Xaa can be any naturally occurring amino acid
  variant (367)..(367): Xaa can be any naturally occurring amino acid
  variant (430)..(430): Xaa can be any naturally occurring amino acid
  variant (452)..(452): Xaa can be any naturally occurring amino acid
  variant (454)..(454): Xaa can be any naturally occurring amino acid
  variant (456)..(456): Xaa can be any naturally occurring amino acid
MGARASILSGGKLDAWEKIRLRPGGXKXYQLKHLVWASRELEXFAVNPGLLETXEGCRQILGXLQPSLQTGSEELKSLFNTVAVLYCVHQRIEIKDTKEALDKIEEEQNKSKKXAQQAAAAAADTGNSSQVSQNFPIXQNMQGQMVHQPLTPRTLNAWVKVVEXKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRXEQASQEVKNWMTETLLVQNXNPDCKTILKALGPAATLEEMMTACQGVGGPSHKARVLXEAMSQATNSATIMMQRGNFRNQRKTVKCFNCGKEGHIARNCRAPRKKGCWKCGKEGHQMKDCXERQANFLGKIWPSHKGRPGNFXQXRXEPSAPPEESFRFGEETTTPSQKQEPTDKGMYPPLASLRSLFGNDPSSQ

SEQ ID NO: 577 - protein, 500 aa, Human immunodeficiency virus
  variant (28)..(28): Xaa can be any naturally occurring amino acid
  variant (304)..(304): Xaa can be any naturally occurring amino acid
  variant (361)..(361): Xaa can be any naturally occurring amino acid
  variant (380)..(380): Xaa can be any naturally occurring amino acid
  variant (387)..(387): Xaa can be any naturally occurring amino acid
  variant (389)..(389): Xaa can be any naturally occurring amino acid
  variant (418)..(418): Xaa can be any naturally occurring amino acid
  variant (490)..(490): Xaa can be any naturally occurring amino acid
MGARASVLSGGKLDKWEKIRLRPGGKKXYKLKHLVWASREVERFLINPGLLETAEGCRQILGQLHPALQTGSEELKSLYNTVATLYCVHQNIDVKDTKEALDKIEEEQNKSKKKAQQAAADSGSSSQVSQNYPIVQNLQGQMVHQPISPRTLNAWVKVVEEKAFSPEVIPMFTALSEGATPQDLNTMLNTVGGHQAAMQMLKETINEEAAEWDRMHPVHAGPIAPGQMREPRGSDIAGTTSNLQEQIGWMTSNPPIPVGEIYKRWIILGLNKIVRMYSPTSILDIRQGPKEPFRDYVDRFYKTXRAEQASQDVKNWMTETLLVQNANPDCKTILKALGPAATLEEMMTACQGVGGPGHKAXVLAEAMSQVTGSATVMMQXGRFRDQXRXVKCFNCGKEGHIAKNCRAPRKKGCWKCGXEGHQMKDCTERQANFLGKIWPSHKGRPGNFLQSRPEPTAPPEESFRFGEETTTPSQKQELKDQEMYPLTSLXSLFGSDPLSQ

SEQ ID NO: 578 - protein, 505 aa, Human immunodeficiency virus
MGARASILSGAELDRWEKIRLRPGGKKNYQLKHLVWASRELERFAVNPSLLETGAGCRQILGQLQPSLQTGSEELKSLFNTVATLYCVHQKIEVKDTKEALDKIEEEQNKSKKKAQQAAADAEKNSQVSQNYPIVQNLQGQMVHQPLSPRTLNAWVKVVEEKAFSPEVIPMFSALAEGATPQDLNTMLNTVGGHQAAMQMLKETINEEAAEWDRLHPVQAGPVAPGQLREPRGSDIAGTTSNLQEQIAWMTHNPPVPVGEIYKRWIILGLNKIVRMYSPISILDIKQGPKEPFRDYVDRFYKTLRAEQGTPDVKQWMTETLLVQNANPDCKSILKAMGPGATLEEMMTACQGVGGPSHKARVLAEAMSQVTNSTNIMMQRGNFKNQRKPVKCFNCGKEGHIARNCRAPRKRGCWKCGKEGHQMKDCSERQANFLGKIWPSHKGRPGNFLQNRTESTASVEPTAPPAESFMFGEETTPPQKQEPRDKELYPSTALRSLFGNDPLSQ

SEQ ID NO: 579 - protein, 500 aa, Human immunodeficiency virus
  variant (61)..(61): Xaa can be any naturally occurring amino acid
  variant (126)..(126): Xaa can be any naturally occurring amino acid
  variant (138)..(138): Xaa can be any naturally occurring amino acid
  variant (160)..(160): Xaa can be any naturally occurring amino acid
  variant (162)..(162): Xaa can be any naturally occurring amino acid
  variant (278)..(278): Xaa can be any naturally occurring amino acid
  variant (283)..(283): Xaa can be any naturally occurring amino acid
  variant (331)..(331): Xaa can be any naturally occurring amino acid
  variant (391)..(391): Xaa can be any naturally occurring amino acid
  variant (409)..(409): Xaa can be any naturally occurring amino acid
  variant (483)..(483): Xaa can be any naturally occurring amino acid
  variant (500)..(500): Xaa can be any naturally occurring amino acid
MGARASVLSGGELDRWEKIRLRPGGNKKYKLKHIVWASRELERFAVNPGLLETSDGCRQIXAQLQPSLQTGSEELKSLFNTVAVLYCVHQRIEVKDTKEALDKVEEEQNKSKKKAQPAAADTGNNXQVSQNYPIVQNXQGQMVHQSLSPRTLNAWVKVIXEXAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYXPVSIXDIRQGPKEPFRDYVDRFYKTLRAEQATQEVKNWMTETLLVQNANPDCXTILKALGPAATLEEMMTACQGVGGPGHKARVLAEAMSQVTSSATIMMQKGNFRNQRKIVXCFNCGKEGHIARNCRAPXKKGCWKCGKEGHQMKECTERQANFLGKIWPSHKGRPGNFLQSRPEPTAPPEESFRFGEETTTPSQKQGTTDQEXYPLVSLKSLFGNDPSSX

SEQ ID NO: 580 - protein, 508 aa, Human immunodeficiency virus
  variant (388)..(388): Xaa can be any naturally occurring amino acid
  variant (460)..(460): Xaa can be any naturally occurring amino acid
MGARASILSGGALDKWEKIRLRPGGKKRYQFKHIIWASRELERFALNPGLLETAEGCRQILGQLQPSLQTGTEELRSLYNTVAVLYCVHQRIDVKDTKEAIEKIEEEQNKSKKKAQQAAAAAADTGNSSTGNNSKVSQNYPIVQNLQGQMVHQPISPRTLNAWVKVVEEKAFSPEVIPMFTALSEGATPQDLNTMLNTVGGHQAAMQMLKETINEEAAEWDRLHPVQAGPVAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCRTILKALGPAATLEEMMTACQGVGGPGHKARVLAEAMSQVTNSNTVMMQXGNFKNQRKTVKCFNCGKEGHIARNCRAPRKRGCWKCGKEGHQMKDCTERQANFLGKIWPSHKGRPGNFLQSXPEPSAPPAESFRFGEETTTPPQKQEPMDKELYPLASLRSLFGNDPSSQ

SEQ ID NO: 581 - protein, 505 aa, Human immunodeficiency virus
  variant (152)..(152): Xaa can be any naturally occurring amino acid
  variant (178)..(178): Xaa can be any naturally occurring amino acid
  variant (193)..(193): Xaa can be any naturally occurring amino acid
  variant (223)..(223): Xaa can be any naturally occurring amino acid
  variant (228)..(228): Xaa can be any naturally occurring amino acid
  variant (370)..(370): Xaa can be any naturally occurring amino acid
MGARASVLSGGELDRWEKIRLRPGGKKKYQLKHIVWASRELERFAVNPGLLETSEGCRQILEQLQPSLQTGSEELKSLFNTIATLYCVHQKIDVKDTKEALEKIEEEQNRSKKKAQQAVADTGNSRQGNNSQVSQNYPIVQNMQGQMVHQPXTPRTLNAWVKVVEEKAFSPEVIPMFXALSEGATPQDLNTMXNTVGGHQAAMQMLKETINEEAAEWDRLHPXHAGPXAPGQMREPRGSDIAGTTSNLQEQIGWMTSNPPIPVGEIYKRWIILGLNKIVRMYSPTSILDIKQGPKEPFRDYVDRFYKTLRAEQASQEVKNWMTETLLVQNSNPDCKTILKALGPAATLEEMMTACQGVGGPGHKARVLAXAMSQMTNSATVMMQRGNFRNQRRTIKCFNCGKEGHIAKNCRAPRKKGCWKCGKEGHQMKDCTERQANFLGKIWPSHKGRPGNFLQSRPEPSAPPEESFRFGEETATPAQKQEPINKELYPLASLRSLFGNDHSSQ

SEQ ID NO: 582 - protein, 503 aa, Human immunodeficiency virus
  variant (34)..(34): Xaa can be any naturally occurring amino acid
  variant (44)..(44): Xaa can be any naturally occurring amino acid
  variant (55)..(55): Xaa can be any naturally occurring amino acid
  variant (82)..(82): Xaa can be any naturally occurring amino acid
  variant (95)..(95): Xaa can be any naturally occurring amino acid
  variant (102)..(102): Xaa can be any naturally occurring amino acid
  variant (104)..(104): Xaa can be any naturally occurring amino acid
  variant (163)..(163): Xaa can be any naturally occurring amino acid
  variant (210)..(210): Xaa can be any naturally occurring amino acid
  variant (225)..(225): Xaa can be any naturally occurring amino acid
  variant (232)..(232): Xaa can be any naturally occurring amino acid
  variant (242)..(242): Xaa can be any naturally occurring amino acid
  variant (297)..(297): Xaa can be any naturally occurring amino acid
  variant (306)..(306): Xaa can be any naturally occurring amino acid
  variant (334)..(334): Xaa can be any naturally occurring amino acid
  variant (374)..(374): Xaa can be any naturally occurring amino acid
  variant (500)..(500): Xaa can be any naturally occurring amino acid
MGARASVLSGGELDRWEKIRLRPGGKKKYRLKHXVWASRELERXAVNPGLLETTXGCRRILEQLQPSLQTGSEELRSLFNTXATLYCVHAKIEVXDTKEALXKXEEEQNKSKKRAQQAAAAADTGNSSKVSQNYPIVQNLQGQMVHQPLSPRTLNAWVKVIEXKAFNPEVIPMFAALSEGATPQDLNTMLNTVGGHQAAMQMLKETINEXAAEWDRLHPVHAGPXAPGQMRXPRGSDIAGTXSTLQEQIGWMTNNPPIPVGEIYKKWIIMGLNKIVRMYSPVSILDIKQGPKEPFRXYVDRFYKTXRAEQATQEVKNWMTETLLVQNANPDCKXILKALGPAATLEEMMTACQGVGGPSHKARVLAEAMSQVTXPTTIMMQKGNFRSQKKTVKCFNCGREGHIAKNCRAPRKRGCWKCGKEGHQMKDCTERQANFLGKIWPSQNKGRPGNFLQSRPEPSAPPAESFRFGEETTTPPQKQEPIDKEMYPLTSLRSLFGNDXSSQ

SEQ ID NO: 583 - protein, 500 aa, Human immunodeficiency virus
  variant (132)..(132): Xaa can be any naturally occurring amino acid
MGARASVLSGGELDRWEKIRLRPGGKKKYKLKHIVWASRELERFAVNPGLLETSDGCRQILGQLQPALQTGSEELKSLYNTVAVLYCVHQKIEIKDTKEALEKIEEEQNKSKKRVQQAAADTGQSSQVSQNXPIVQNLQGQMVHQPLSPRTLNAWVKVVEEKAFSPEVIPMFSALSEGATPQDLNTMLNTVGGHQAAMQMLKETINEEAADWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQATNAANIMMQKGNFRNQKKSVRCFNCGKEGHIARNCRAPRKRGCWKCGKEGHLMKDCTERQANFLGKIWPSHKGRPGNFLQSRPEPTAPPEESFRFGEKTTAPSQKQEPIDKEMYPLASLRSLFGNDPSSQ

SEQ ID NO: 584 - protein, 500 aa, Human immunodeficiency virus
MGARASVLSGGELDRWEKIRLRPGGKKQYRLKHIVWASRELERFAVNPGLLETAGGCRQILEQLQPSLQTGSEELRSLYNTVATLYCVHQKIDVRDTKEALDKIEEEQNKSKKKAQQAAADTGSCSQASQNYPIVQNLQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIGWMTSNPPTPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQKGNFRNQRKSVKCFNCGKEGHIARNCRAPRKKGCWKCGKEGHQMKDCTERQANFLGKIWPSHKGRPGNFLQSRPEPTAPPAPPEESFRFGEETTTPSQRQEMTDKEKYPLASLRSLFGNDP

SEQ ID NO: 585 - protein, 499 aa, Human immunodeficiency virus
MGARASVLSGGELDRWEKIRLRPGGKKKYKLKHLVWASRELERFAVNPGLLETSAGCRQILGQLQPSLQTGSEELKSLYNTVATLYCVHQRIDVKDTKEALEKIEEEQNKSKKKAQQAAADTGNGSQVSQNYPIVQNIQGQMVHQPISPRTLNAWVKVVEEKAFSPEVIPMFSALAEGATPQDLNTMLNTVGGHQAAMQMLKETINEEAAEWDRVHPVQAGPIAPGQIREPRGSDIAGTTSNLQEQIAWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNPVNIMMQRGNFRNQRKTVKCFNCGKEGHIAKNCRAPRKRGCWKCGKEGHQMKDCTERQANFLGKIWPSHKGRPGNFLQSRPEPTAPPEESFRFGEETATSQKQDPIDKEMYPLTSLRSLFGNDPSSQ

SEQ ID NO: 586 - protein, 502 aa, Human immunodeficiency virus
MGARASVLSGGDLDRWEKIRLRPGGKKKYQLKHIVWASRELERFAVNPGLLETSEGCRQILGQLQPSLQTGSEELRSLFNTVATLYCVHQKIDVKDTKEALEKIEEEQNKSKKKAQQAAAAADTGNSSQVSRNYPIVQNIQGQMVHQPLSPRTLNAWVKVVEEKNFSPEVIPMFSALSEGATPQDLNTMLNTIGGHQAAMQMLKETINEEAAEWDRLHPAQAGPIAPGQIREPRGSDIAGTTSNLQEQITWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPAHKARVLAEAMSQVTNSTAIMMQKGNFRNQRRSVKCFNCGKEGHIAKNCRAPRKRGCWKCGKEGHQMKDCTERQANFLGKIWPSHKGRPGNFLQSRPEPTAPPEESFRFGEETTTPSQKQDPKDKDLYPLASLRSLFGNDPSSQ

SEQ ID NO: 587 - protein, 501 aa, Human immunodeficiency virus
  variant (445)..(445): Xaa can be any naturally occurring amino acid
  variant (454)..(454): Xaa can be any naturally occurring amino acid
MGARASVLSGGELDRWEKIRLRPGGKKQYKLKHIVWASRELERFAVNPGLLETAEGCRQILRQLQPALQTGSEGLTSLYNTVATLYCVHSRIEVKDTKEALDKIEEEQNKSKKKAQPTVADAGNNSNQVSQNYPIVQNLQGQMVHQPMTPRTLNAWVKVVEEKAFSPEVIPMFSALAEGATPQDLNTMLNTVGGHQAAMQILKETINEEAADWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQVTNSATIMMQKGNFGNQRRTVKCFNCGKVGHIAKNCRAPRKKGCWKCGKEGHQMKDCTERQANFLGKIWPSHKGXPGNFLQSRXEPTAPPEESFRFGEETTTPPQKQEPIDREGYPLTSLKSLFGNDPLSQ

SEQ ID NO: 588 - protein, 502 aa, Human immunodeficiency virus
MGARASVLSGGELDRWEKIRLRPGGNKRYKLKHIVWASRELERFAVNPGLLETGDGCKQIIEQLQPSLQTGSEELRSLYNTVAVLYCVHQRIEIQDTKEALDKIEEEQNKSKKKAQQKAAAADTGNSSQVSQNYPIVQNMQGQMVHQPLSPRTLNAWVKVVEEKAFSPEVIPMFTALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIKQGPKEPFRDYVDRFYKTLRAEQATQEVKNWMTETLLVQNANPDCKTILKALGPGATLEDMMTACQGVGGPGHKARVLAEAMSQLTNSTAIMMQRGNFRNQRKTVKCFNCGKEGHIARNCRAPRKKGCWKCGKEGHQMKDCTERQANFLGKIWPSHKGRPGNFLQSRPEPTAPPEESFRFGEETTAPPQKQDQIDKELYPSASLKSLFGNDPSSQ

SEQ ID NO: 589 - protein, 499 aa, Human immunodeficiency virus
  variant (357)..(357): Xaa can be any naturally occurring amino acid
  variant (467)..(467): Xaa can be any naturally occurring amino acid
MGARASVLSGGELDKWEKIRLRPGGKKQYKLKHIVWASRELERFAVNPGLLETADGCRQILGQLQPSLQTGSEELRSLYNTIAVLYCVHQRIEVKDTKEALDKIEEEQNKCKKKAQQAAADTGNNSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQIREPRGSDIAGTTSTLQEQIAWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPXHKARVLAEAMSQVTNSATVMMQKGNFKGQRRSVKCFNCGKEGHIARNCRAPRKRGCWKCGKEGHQMKDCTERQANFLGKIWPSHKGRPGNFLQSRPEPTAPPAESFRFGXETTPSQKPEGIDKEMYPLASLKSLFGNDPSSQ

SEQ ID NO: 590 - protein, 496 aa, Human immunodeficiency virus
  variant (459)..(459): Xaa can be any naturally occurring amino acid
MGARASVLSGGELDRWEKIRLRPGGKKKYKLKHIVWASRELERFAVNPGLLETAEGCRRILGQLQPSLQTGSEELKSLYNTVAVLYCVHQKIEIKDTKEALDKIEEEQNKSKKKAQQAAADTGNGSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVNSTTVMMQRGNFKNQRRIVKCFNCGKEGHIAKNCRAPRKKGCWKCGQEGHQMKDCTERQANFLGKIWPSHKGRPGNFLQSRPEPTAPPXESFRFGEGTTTPPQKQEPRDKELYPLASLKSLFGSDP

SEQ ID NO: 591 - protein, 502 aa, Human immunodeficiency virus
  variant (26)..(26): Xaa can be any naturally occurring amino acid
  variant (197)..(197): Xaa can be any naturally occurring amino acid
  variant (282)..(282): Xaa can be any naturally occurring amino acid
  variant (409)..(409): Xaa can be any naturally occurring amino acid
  variant (467)..(467): Xaa can be any naturally occurring amino acid
MGARASVLSGGQLDRWEKIRLRPGGXKKYRLKHLVWASRELERFAVNPGLLETAEGCRQIIGQLQPSLQTGSEELRSLFNTVATLYCVHQRIDVKDTKEALEKVEEEQNQSKKKAQQAAADTGNSSQVSQNYPIVQNLQGQMVHQAISPRTLNAWVKVVEEKAFSPEVIPMFSALSEGATPQDLNTMLNTVGGHQAXMQMLKETINEEAAEWDRLHPVHAGPTAPGQMREPRGSDIAGTTSTLQEQIGWMTSNPPIPVGEIYKRWIIMGLNKIVRMYSPTSXLDIKQGPKEPFRDYVDRFYKTLRAEQATQEVKNWMTETLLVQNANPDCKTILKALGPAATLEEMMTACQGVGGPAHKARVLAEAMSQVTGSATIMMQKGNFGNQKKTIKCFNCGKIGHIARNCRAPXKKGCWKCGKEGHQMKDCIERQANFLGKIWPSHKGRPGNFLQNRPEPTAPPAESFGFGXEITTHSQKQESIDKDKELYPLTSLKSLFGNDPSSQ

SEQ ID NO: 592 - protein, 497 aa, Human immunodeficiency virus
  variant (469)..(469): Xaa can be any naturally occurring amino acid
MGARASVLSGGKLDKWEKIRLRPGGKKKYKLKHIVWASRELERFALNPGLLETLEGCRQILGQIQPSLQTGSEELRSLYNTVATLYCVHQGIDIKDTKEALDRIEEEQNKSKKQAAAGPGNNSQVSQNYPIVQNMQGQMVHQAISPRTLNAWVKVVEEKAFSPEVIPMFAALSEGATPQDLNTMLNTVGGHQAAMQMLKETINEEAAEWDRLHPVHAGPTAPGQMRDPRGSDIAGTTSTLQEQIGWMTSNPPIQVGEIYKRWIILGLNKIVRMYSPTSILDIKQGPKEPFRDYVDRFYKTLRAEQATQEVKNWMTETLLVQNANPDCKTILKALGPAATLEEMMTACQGVGGPSHKARVLAEAMSQVTGTNTIMMQRGNFRNQRKIVKCFNCGKEGHIAKNCRAPRKKGCWKCGKEGHQMKDCTERQANFLGKFWPSHKGRPGNFLQSRPEPTAPPEESFRFGEETPTXSQKQDQIDKELYPSASLKSLFGNDPLLQ

SEQ ID NO: 593 - protein, 502 aa, Human immunodeficiency virus
MGARASVLSGGQLDRWEKIRLRPGGKKQYKLKHIVWASRELERFAVNPALMESAEGCKQILAQLQPSIQTGSEELKSLYNAIAVLYCVHQRIEIKDTKEALDKIQEEQNKSKKKAQQAAAAADAGNSSQASQNYPIVQNLQGQMVHQAISPRTLNAWVKVVEEKAFSPEVIPMFSALSEGATPQDLNTMLNSVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNSNPDCKTILKALGPGATLEDMMTACQGVGGPGHKARVLAEAMSQITNNTANIMMQKGNFRSQRKIKCFNCGREGHIAKHCRAPRKKGCWKCGKEGHQMKDCTERQANFLGKIWPSNKGRPGNFLQSRPEPTAPPEESFRFGEETTTPSQKQEQINKELYPSVSLKSLFGNDPSSQ

SEQ ID NO: 594 - protein, 504 aa, Human immunodeficiency virus
  variant (97)..(97): Xaa can be any naturally occurring amino acid
  variant (468)..(468): Xaa can be any naturally occurring amino acid
MGARASILSGGELDRWEKIRLRPGGKKKYRLKHIVWASRELERFAVNPGLLETSEGCRQILGQLQPSLQTGSEELKSLYNTIATLYCVHRKIEVKDXKEALDMVEEEQNKSKKKAQQAAAAADTGNSSSKVSQNYPIVQNLQGQMVHQAISPRTLNAWVKVVEEKAFSPEVIPMFSALSEGATPQDLNTMLNTVGGHQAAMQMLKETINEEAAEWDRLHPVQAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTHPATIMMQRGNFRNQRKIIKCFNCGKEGHIAKNCRAPRKKGCWKCGKEGHQMKDCTERQANFLGKIWPSHKGGRPGNFLQSRPEPTAPPAESFXFGEETATPPPKQEPIDKELYPLASLKSLFGNDPLSQ

SEQ ID NO: 595 - protein, 500 aa, Human immunodeficiency virus
  variant (95)..(95): Xaa can be any naturally occurring amino acid
  variant (138)..(138): Xaa can be any naturally occurring amino acid
  variant (162)..(162): Xaa can be any naturally occurring amino acid
  variant (389)..(389): Xaa can be any naturally occurring amino acid
  variant (451)..(451): Xaa can be any naturally occurring amino acid
  variant (455)..(455): Xaa can be any naturally occurring amino acid
MGARASVLSGGELDRWEKIRLRPGGKKKYRLKHIVWASRELERFALNPGLLETSEGCRQILGQLQSSLETGSEEIKSLFNTIATLYCVHQRIDVXDTKEALEKIEEEQNKSKKQAQKAAADTGSKNQVSQNYPIVQNXQGQMVHQAISPRTLNAWVKVVEEXAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSANVMMQRGNFKNQRRXVKCFNCGKEGHIARNCRAPRKKGCWKCGKEGHQMKDCTERQANFLGKIWPSHKGRPGNFLQXRPEXSAPPEESFRFGEETATPSQKQEPRDKELYPLTSLKSLFGSDPSLQ

SEQ ID NO: 596 - protein, 500 aa, Human immunodeficiency virus
  variant (90)..(90): Xaa can be any naturally occurring amino acid
  variant (268)..(268): Xaa can be any naturally occurring amino acid
  variant (302)..(302): Xaa can be any naturally occurring amino acid
  variant (322)..(322): Xaa can be any naturally occurring amino acid
  variant (338)..(338): Xaa can be any naturally occurring amino acid
  variant (357)..(357): Xaa can be any naturally occurring amino acid
  variant (418)..(418): Xaa can be any naturally occurring amino acid
  variant (473)..(473): Xaa can be any naturally occurring amino acid
MGARASVLSGGELDRWEKIRLRPGGRKKYKLKHIVWASRELERFAVNPGLLETSDGCRQILQQLQPALQTGSEDLRSLYNTIATIYCVHXKIDVKDTKEALEKIEEEQNKSKKKEQQAAAGTGNISQVSQNYPIVQNLQGQMVHQPLSPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIIXGLNKIVRMYSPVSILDIKQGPKEPFRDYVDRFYXTLRAEQATQEVKNWMTETLXVQNANPDCKTILKALXPAATLEEMMTACQGVGGPXHKARVLAEAMSQVTNSTNIMMQRGNFKNQRKAVKCFNCGKEGHIAKNCRAPRKKGCWKCGXEGHQMKDCTERQANFLGKVWPSHKGRPGNFLQNRPEPTAPPEESFRFGDETATPXQKQEPIDKEMYPLASLRSLFGNDPSSQ

SEQ ID NO: 597 - protein, 499 aa, Human immunodeficiency virus
  variant (183)..(183): Xaa can be any naturally occurring amino acid
  variant (228)..(228): Xaa can be any naturally occurring amino acid
  variant (275)..(275): Xaa can be any naturally occurring amino acid
  variant (392)..(392): Xaa can be any naturally occurring amino acid
  variant (395)..(395): Xaa can be any naturally occurring amino acid
  variant (416)..(416): Xaa can be any naturally occurring amino acid
MGARASVLSGGELDKWEKIRLRPGGKKKYQLKHIVWASRELERFAVNPGLLETGDGCRKILGQLQPSLQTGSEELKSLFNTVATLYCVHQKIDVKDTREALDKIEEEQNKCKKKAQQATADTGNSNQVSQNYPIVQNLQGQMVHQAISPRTLNAWVKVVEEKAFSPEVIPMFTALSEGATPQXLNTMLNTVGGHQAAMQMLKETINEEAAEWDRLHPVQAGPIAPGQXREPRGSDIAGTTSTLQEQIGWMTSTPPIPVGEIYKRWIILGLNKIVXMYSPSSILDIKQGPKEPFRDYVDRFYKTLRAEQASQEVKAWMTETLLVQNSNPDCKTILKALGPGATLEEMMTACQGVGGPGHKARVLAEAMSQVTNSATIMMQKGNFRNQRKSVKXFNXGKEGHIARNCRAPRKKGCWKXGKEGHQMKDCTERQANFLGKIWPSHKGRPGNFLQNRPEPTAPPAESFGFGEEITTPPQKQEPIDKELYPLVSLKSLFGNDHSS

SEQ ID NO: 598 - protein, 500 aa, Human immunodeficiency virus
  variant (46)..(46): Xaa can be any naturally occurring amino acid
  variant (64)..(64): Xaa can be any naturally occurring amino acid
  variant (77)..(77): Xaa can be any naturally occurring amino acid
  variant (79)..(79): Xaa can be any naturally occurring amino acid
  variant (88)..(88): Xaa can be any naturally occurring amino acid
  variant (109)..(109): Xaa can be any naturally occurring amino acid
  variant (111)..(111): Xaa can be any naturally occurring amino acid
  variant (126)..(126): Xaa can be any naturally occurring amino acid
  variant (157)..(157): Xaa can be any naturally occurring amino acid
  variant (162)..(162): Xaa can be any naturally occurring amino acid
  variant (168)..(168): Xaa can be any naturally occurring amino acid
  variant (269)..(269): Xaa can be any naturally occurring amino acid
  variant (312)..(312): Xaa can be any naturally occurring amino acid
  variant (315)..(315): Xaa can be any naturally occurring amino acid
  variant (406)..(406): Xaa can be any naturally occurring amino acid
  variant (411)..(411): Xaa can be any naturally occurring amino acid
  variant (478)..(478): Xaa can be any naturally occurring amino acid
MGARASVLSGGELDKWEKIRLRPGGKKKYKLKHIVWASRELERFAXNPGLLETTEGCRQILGQXQPSLQTGSEELKXLXNTIAVLYCXHQRIEVKDTKEALDKIEEEQXKXKKKAQQAAADTGNSXQVSQNYPIVQNLQGQMVHQAISPRTLNAWVXVIEEXAFSPEXIPMFSALSEGATPQDLNTMLNTVGGHQAAMQMLKETINEEAAEWDRLHPPQAGPVAPGQIRDPRGSDIAGTTSNLQEQITWMTSNPPIPVGEIYKRWIILXLNKIVRMYSPVSILDIRQGPKEPFRDYVDRFYKTLRAEQATQXVKXWMTETLLVQNANPDCKTILKALGPAATLEEMMTACQGVGGPGHKARVLAEAMSHMTNANAIMMQRGNFRNQRKTVKCFNCGKEGHIARNCXAPRKXGCWKCGKEGHQMKECTERQANFLGKIWPSHKGRPGNFLQSRPEPTAPPAESFRFGEETAPPSQKQEXIKEEMYPLASLKSLFGNDPSSQ

SEQ ID NO: 599 - protein, 502 aa, Human immunodeficiency virus
  variant (31)..(31): Xaa can be any naturally occurring amino acid
  variant (119)..(119): Xaa can be any naturally occurring amino acid
  variant (149)..(149): Xaa can be any naturally occurring amino acid
  variant (165)..(165): Xaa can be any naturally occurring amino acid
  variant (221)..(221): Xaa can be any naturally occurring amino acid
  variant (225)..(225): Xaa can be any naturally occurring amino acid
  variant (245)..(245): Xaa can be any naturally occurring amino acid
  variant (257)..(257): Xaa can be any naturally occurring amino acid
MGARASVLSGGELDRWEKIRLRPGGKKKYRXKHIVWASRELERFAVNPGLLETSGGCRQILEQLQPSLQTGSEELRSLYNTVATLYCVHQKIDIRDTKEALDKIEEEQNKSKKKAQQAXAAADTGNSSQVSQNYPIVQNMQGQMVHQPXTPRTLNAWVKVVEEKXFSPEVIPMFTALSEGATPQDLNTMLNTVGGHQAAMQMLKETINEEAAEWDRLHPVXAGPXAPGQIREPRGSDIAGTTSNXQEQVTWMTSNPXIPVGEIYKRWIILGLNKIVRMYSPTSILDIKQGPKEPFRDYVDRFYKTLRAEQATQEVKNWMTETLLVQNANPDCKTILRALGPGATLEEMMSACQGVGGPGHKARVLAEAMSQMTAQTNIMMQRGNFGNQRKPVKCFNCGKTGHIAKNCRAPRRKGCWKCGKEGHQMKDCTERQANFLGKIWPSHKGRPGNFLQSRPEPSAPPEESFRFGEETATPSQKQETIDKEMYPLASLKSLFGNDPSSQ

SEQ ID NO: 600 - protein, 502 aa, Human immunodeficiency virus
MGARASVLSGGKLDRWEKIRLRPGGKKKYKLKHIVWASRELERFAVNPGLLETSEGCRQILGQLQPSLQTGSEELKSLFNTIATLYCVHQGIEVKDTKEALDKIEEEQNKSKKKAQQAAAAADTGNNSPVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIAWMTNNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPGHKARVLAEAMSQVTNNPVIMMQRGNFRNQRKTVKCFNCGKEGHLARNCRAPRKKGCWKCGKEGHQMKECTERQANFLGKIWPSHKGRPGNFLQSRPEPTAPPEESFRFGEETATPPQKQEPIDKELYPLASLKSLFGNDPSSQ

SEQ ID NO: 601 - protein, 500 aa, Human immunodeficiency virus
  variant (24)..(24): Xaa can be any naturally occurring amino acid
  variant (46)..(46): Xaa can be any naturally occurring amino acid
  variant (51)..(51): Xaa can be any naturally occurring amino acid
  variant (163)..(163): Xaa can be any naturally occurring amino acid
  variant (197)..(197): Xaa can be any naturally occurring amino acid
  variant (203)..(203): Xaa can be any naturally occurring amino acid
  variant (384)..(384): Xaa can be any naturally occurring amino acid
  variant (409)..(409): Xaa can be any naturally occurring amino acid
  variant (480)..(480): Xaa can be any naturally occurring amino acid
MGARASVLSAGELDKWEKIRLRPXGKKKYRLKHIVWASRELERFAXNPGLXETSEGCRQILGQLQPALQTGSEELRSLYNTVATLYCVHSKIEVKDTKEALEKIEEEQNRSKKQTQQVAAGTGNSSQASQNYPIVQNLQGQMVHQPISPRTLNAWVKVVEEKXFSPEVIPMFSALSEGATPQDLNTMLNTVGGHQAXMQMLKXTINEEAAEWDRLHPAQAGPIAPGQIREPRGSDIAGTTSTLAEQIAWMTNNPPIPVGDIYKRWIILGLNKIVRMYSPTSILDIRQGPKEPFRDYVDRFYKCLRAEQASQDVKNWMTETLLVQNANPDCKTILKALGPAATLEEMMTACQGVGGPSHKARVLAEAMSQATNPANIMMQRGNFXNQRKTVKCFNCGKAGHIAKNCRAPXKKGCWKCGKEGHQMKDCNERQANFLGKIWPSHKGRPGNFLQSRPEPTAPPEESFSFGEETTTPPQRQEPIXKEMYPLTALKSLFGNDPSSQ

SEQ ID NO: 602 - protein, 500 aa, Human immunodeficiency virus
MGARASILSGGELDKWEKIRLRPQGKKKYKLKHLVWASRELERFAVNPGLLETTEGCRQILGQLQPSLQTGSEELRSLYNTIAVLYCVHQRIDVKDTKEALDRIEEEQNKSKKRAQQAAADTGNSSQVSQNYPIVQNMQGQMVHQALSPRTLNAWVKVVEEKAFSPEVIPMFSALSEGATPQDLNTMLNTVGGHQAAMQMLKETINEEAAEWDRLHPVHAGPPAPGQLREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTNSATIMMQRGSYKNQRKAVKCFNCGKEGHIAKNCRAPRKKGCWKCGKEGHQMKDCTERQANFLGKIWPSHKGRPGNFLQSRPEPSAPPEESFRFGEETATPSQRQEQKDKELYPLASLRSLFGNDPSSQ

SEQ ID NO: 603 - protein, 495 aa, Human immunodeficiency virus
MGARASVLSGGELDRWEKIRLRPGGKKKYQLKHIVWASRELERFAVNPGLLETSEGCKQILGQLQPSLQTGSEELRSLFNTVAVLYCVHQKIDVKDTKEALDKIEEEKKAQQAAAATGTSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPVAPGQMRDPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNSNPDCKTILKALGPGATLEEMMTACQGVGGPGHKARVLAEAMSQMTNSATIMMQKGNFRNQRKPVKCFNCGKEGHIAKNCRAPRKKGCWKCGKEGHQMKDCNERQANFLGKIWPSQKGRPGNFPQSRTEPTAPPAESFRFGEETTAPLQKQEPIDKELYPLASLKSLFGNDPLSQ

SEQ ID NO: 604 - protein, 500 aa, Human immunodeficiency virus
  variant (178)..(178): Xaa can be any naturally occurring amino acid
  variant (258)..(258): Xaa can be any naturally occurring amino acid
MGARASVLSAGELDKLEKIRLRPGGKKKYRLKHLVWASRELERFAVNPGLLETSGGCRQILGQLQPSLPTGSEELRSLYNTIAVLYCVHQKIEVKDTKEALDKIEEEQNKSKKKAQQAAADTGNSSQVSQNYPIVQNLQGQMVHQPLSPRTLNAWVKVVEEKAFSPEVIPMFSALSEXATPQDLNTMLNTVGGHQAAMQMLKETINEEAAEWDRLHPVHAGPIAPGQMREPRGSDIAGTTSTLQEQIGWMTHNPPIPXGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQMTNPAAIMMQRGNFRNQRKIVKCFNCGKEGHIAKNCRAPRKKGCWKCGQEGHQMKDCIERQANFLGKIWPSHKGRPGNFLQSRPEPTAPPAESFRFGEETTAPPQKQEQIDKDLYPMASLKSLFGSDPSSQ

SEQ ID NO: 605 - protein, 501 aa, Human immunodeficiency virus
MGARASVLSGGELDRWEKIRLRPGGKKKYKLKHIVWASRELERFAVNPGLLETSDGCRQILKQLQPSIQTGSEELRSLFNTVAVLYCVHQRIEIKDTKEALEKIEEEQNKSKKKAQQQQAAADTGNSNQSSQNYPIVQNLQGQMVHQPISPRTLNAWVKVIEEKAFSPEVIPMFSALSEGATPTDLNIMLNTVGGHQAAMQMLKETINEEAAEWDRLHPVHAGPIAPGQMREPRGSDIAGTTSNLQEQIGWMTNNPPIPVGDIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTNSATIMMQKGNFRNQRKTVKCFNCGKEGHVARNCRAPRKRGCWKCGKEGHQMKECTERQANFLGKIWPSHKGRPGNFLQSRPEPSAPPEESFRFGEETATPSQRQEPIDKEKEMYPLASLKSLFGNDP

SEQ ID NO: 606 - protein, 503 aa, Human immunodeficiency virus
  variant (17)..(17): Xaa can be any naturally occurring amino acid
  variant (49)..(49): Xaa can be any naturally occurring amino acid
  variant (58)..(58): Xaa can be any naturally occurring amino acid
  variant (83)..(83): Xaa can be any naturally occurring amino acid
  variant (91)..(91): Xaa can be any naturally occurring amino acid
  variant (139)..(139): Xaa can be any naturally occurring amino acid
  variant (144)..(144): Xaa can be any naturally occurring amino acid
  variant (162)..(162): Xaa can be any naturally occurring amino acid
  variant (260)..(260): Xaa can be any naturally occurring amino acid
  variant (269)..(269): Xaa can be any naturally occurring amino acid
  variant (327)..(327): Xaa can be any naturally occurring amino acid
  variant (337)..(337): Xaa can be any naturally occurring amino acid
  variant (382)..(382): Xaa can be any naturally occurring amino acid
  variant (407)..(407): Xaa can be any naturally occurring amino acid
MGARASVLSGGQLDRWXKIRLRPGGKKKYRLKHLVWASRELERFAVNPXLMETSEGCXQILGQLHPSIQTGSEEIKSLYNTIXTLYCVHQXIEVKDTKEALDKIEEEQNKCKKQVQQAAAATGSSSQVSQNYPIVQNLXGQMVXQSLSPRTLNAWVKVVEEXAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGXIYKRWIIMXLNKIVRMYSPVSILDIKQGPKEPFRDYVDRFYKTLRAEQGSQEVKNWMTETLLVQNAXPDCKIILKGXGAGATLEEMMTACQGVGGPGHKARILAEAMSQVTNPATIMMQRGXFRPQRKIVKCFNCGKEGHIAKNCRXPRKKGCWKCGKEGHQMKDCAERQANFLGRIWPSHKGRPGNFLQSRPEPSAPPEPTAPPEESFRFGEKTTTPSQKQEQIDKELYPLTSLKSLFGSDP

SEQ ID NO: 607 - protein, 500 aa, Human immunodeficiency virus
  variant (251)..(251): Xaa can be any naturally occurring amino acid
MGARASVLSGGELDRWEKIRLRPMGKKKYRLKHIVWASKELERFAVNPGLLETSEGCKQILIQLQPSLQTGSEELRSLYNTVATLYCVHQKIEVKDTKEALDRIEEEQNKSKKKAQQAAADTGNSSQVSQNYPIVQNLQGQMVHQPISPRTLNAWVKVVEEKAFSPEVIPMFSALSEGATPQDLNTMLNTVGGHQAAMQMLKETINEEAAEWDRIHPVHAGPVAPGQMREPRGSDIAGTTSTLQEQINWMXSNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTGSATIMMQKGNFRNQRKTVKCFNCGKEGHIARNCRAPRKKGCWKCGKEGHHIKDCTERQANFLGRIWPSTKGRPGNFLQNRPEPTAPPAESFRFGEETTTPSQKQEPIDKELYPLASLRSLFGNDPSSQ

SEQ ID NO: 608 - protein, 505 aa, Human immunodeficiency virus
  variant (232)..(232): Xaa can be any naturally occurring amino acid
  variant (458)..(458): Xaa can be any naturally occurring amino acid
MGARASVLSGGELDRWEKIRLRPGGKKKYKLKHVVWASRELERFAVNPGLLETSGGCRQILEQLQPSLQTGSEELKSLYNTIAVLYCVHQRIEVKDTKEALDKIEEEQNKSKKKAQQAAADTGNNSNSQVSQVSQNYPIVQNAQGHMVHQAISPRTLNAWVKVVEEKAFSPEVIPMFSALSEGATPQDLNTMLNTVGGHQAAMQMLKETINEEAAEWDRLHPVHAGPVAPGXMREPRGSDIAGTTSTLQEQIGWMTNNPPIPVGEIYKRWIIMGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNSATIMMQRGNFRNQRKMVKCFNCGKEGHIAKNCRAPRKKGCWKCGREGHQMKDCTERQANFLGKIWPSHKGRPGNFLQSRXEPTAPPEESFRFGEETTAPSQKQEPIDKELYPLASLRSLFGNDPSSQ

SEQ ID NO: 609 - protein, 501 aa, Human immunodeficiency virus
  variant (22)..(22): Xaa can be any naturally occurring amino acid
  variant (30)..(30): Xaa can be any naturally occurring amino acid
  variant (44)..(44): Xaa can be any naturally occurring amino acid
  variant (63)..(63): Xaa can be any naturally occurring amino acid
  variant (160)..(160): Xaa can be any naturally occurring amino acid
  variant (165)..(165): Xaa can be any naturally occurring amino acid
  variant (198)..(198): Xaa can be any naturally occurring amino acid
  variant (217)..(217): Xaa can be any naturally occurring amino acid
  variant (219)..(219): Xaa can be any naturally occurring amino acid
  variant (293)..(293): Xaa can be any naturally occurring amino acid
MGARASVLSGGGLDRWEKIRLXPGGKKKYXLKHIVWASRELERXAVNPGLLETSDGCRQILQXLQPSLKTGSEELTSLYNTVATLYCVHQKIDVKDTKEALDKIEEEQNKSKTQAQQAAAANTGNSSQVSQNYPIVQNIQGQMVHQPLSPRTLNAWVKVXEEKAXSPEVIPMFSALSEGATPQDLNTMLNTVGGHQAXMQMLKETINEEAADWDRLXPXHAGPIAPGQMREPRGSDIAGSTSTLQEQIGWMTSNPPIPVGEIYKRWIILGLNKIVRMYSPTSILDIKQGPKEXFRDYVDRFYKTLRAEQCTQEVKNWMTETLLVQNSNPDCKTILKALGPAATLEEMMTACQGVGGPGHKARVLAEAMSQVTSSTIMMQRGNFKSQRKTIKCFNCGKEGHLARNCRAPRKKGCWKCGKEGHQMKECTERQANFLGKIWPSHKGRPGNFLQSRPEPTAPPLPPEESFREEATAPPQKQDPIDKELYPLTSLKSLFGSDPSSQ

SEQ ID NO: 610 - protein, 503 aa, Human immunodeficiency virus
  variant (250)..(250): Xaa can be any naturally occurring amino acid
  variant (263)..(263): Xaa can be any naturally occurring amino acid
  variant (340)..(340): Xaa can be any naturally occurring amino acid
  variant (361)..(361): Xaa can be any naturally occurring amino acid
  variant (364)..(364): Xaa can be any naturally occurring amino acid
  variant (406)..(406): Xaa can be any naturally occurring amino acid
  variant (412)..(412): Xaa can be any naturally occurring amino acid
  variant (459)..(459): Xaa can be any naturally occurring amino acid
MGARASVLSGGQLDRWEKIRLRPGGKKRYKLKHIVWASRELERFAVNPGLLETSEGCRQILGQLQPSLQTGSEELKSLYNTVATLYCVHQRIDVKDTKEALDKIEEEQNKSKKKEQQAVADTGSKSQVSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGVTSTLQEQXGWMTSNPPIPVGXVYKKWIIIGLNKIVRMYSPTSILDIRQGPKEPFRDYVDRFYKTLRAEQASQEVKNWMTETLLVQNANPDCRTILKAXGPAATLEEMMTACQGVGGPGXKAXVLAEAMSQATNSAAIMVQRGNYKGQRKTVKCFNCGKEGHISXNCRAPXKKGCWKCGKEGHQMKECTERQANFLGKIWPSHKGRPGNFLQNRPEPXAPPEESFRFGEEPATPPQKQEPMDKELYPLASLRSLFGNDPSSQ

SEQ ID NO: 611 - protein, 504 aa, Human immunodeficiency virus
  variant (114)..(114): Xaa can be any naturally occurring amino acid
  variant (358)..(358): Xaa can be any naturally occurring amino acid
  variant (436)..(436): Xaa can be any naturally occurring amino acid
  variant (488)..(488): Xaa can be any naturally occurring amino acid
MGARASVLSGGELDRWEKIRLRPGGKKKYKLKHIVWASRELERFAVNPGLLETSGGCRQILAQLQPALQTGSEELKSLYNTVAVLYCVHQQIEIKDTKEALDKIEEEQNKSKKXAQQTAADAAAASSQVSQNYPIVQNLQGQMVHQAISPRTLNAWVKVVEEKAFSPEVIPMFSALSEGATPQDLNTMLNTVGGHQAAMQMLKETINEEAAEWDRMHPVHAGPIAPGQMREPRGSDIAGTTSTLQEQIGWMTSNPPIPVGEIYKRWIILGLNKIVRMYSPTSILDIKQGPKEPFRDYVDRFYKVLRAEQASQDVKNWMTETLLVQNANPDCKTILKALGPAATLEEMMTACQGVGGPXHKARVLAEAMSQVTSSAAIMMQKGNFRSQRKTVKCFNCGKEGHIARNCRAPRKKGCWKCGREGHQMKDCDERQANFLXKIWPSHKGRPGNFLQNRPEPTAPPSRTEPTAPPEESFRFGEETTTPSQKQEXERYPLASLRSLFGNDP

SEQ ID NO: 612 - protein, 509 aa, Human immunodeficiency virus
MGARASVLSGGKLDSWEKIRLRPGGRKKYKLKHIVWASRELERFAVNPGLLETAEGCRKILGQLQPSLQTGSEELKSLYNTIAVLYCVHQRIDVKDTKEALEKIEEEQNKSKKKAQQAAADTGNSSQVSQNYPIVQNLQGQMVHQAISPRTLNAWVKVVEEKSFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILRALGPAATLEEMMTACQGVGGPGHKARVLAEAMSQVTNSNTIMMQRGNFRNQRKSVKCFNCGKEGHIAKNCRAPRRKGCWKCGKEGHQMKDCTERQANFLGKIWPSHKGRPGNFLQSRPEPTAPQSRPEPTAPPAESFRFGEETITPSPKQEPIDKGLYPSDSLRSLFGNDPLSQ

SEQ ID NO: 613 - protein, 497 aa, Human immunodeficiency virus
  variant (143)..(143): Xaa can be any naturally occurring amino acid
MGARASVLSGGKLDKWEKIRLRPGGKKKYKLKHIVWASRELERFAINPGLLETSEGCRQILGQLHSSLQTGSEELRSLYNTVATLYCVHQDIGVKDTKEALDRVEEEQNKIKKSAQQAADTGNSSKVVSQNYPIVQNLQGQMXHQAISPRTLNAWVKVIEEKAFSPEVIPMFTALSEGATPQDLNTMLNTVGGHQAAMQMLKETINEEAAEWDRLHPVQAGPVAPGQMREPRGSDIAGTTSTLQEQIAWMTSNPPVPVGEIYKRWIILGLNKIVRMYSPVSILDIKQGPKEPFRDYVDRFYKTLRAEQASVEVKNWMTETLLVQNSNPDCKTILKALGPSATLEEMMTACQGVGGPGHKARVLAEAMSQVTNSANVMMQRGNFRNQRKTVKCFNCGKEGHIARNCRAPRKKGCWKCGKEGHQMKDCTERQANFLGKIWPSHKGRPGNFPQSRTEPSAPPEESFPETATPFQRQEPIDKELSPLASLKSLFGNDPSSQ

SEQ ID NO: 614 - protein, 504 aa, Human immunodeficiency virus
MGARASVLSGGELDRWEKIRLRPGGKKKYRLKHIVWASRELERFAVNPGLLETAAGCRQILGQLQPSLQTGSEELKSLYNAIAVLYCVHQKIDVKDTKEALDKIEEEQKKSKKTTQQAAAAAAADTGNSSQVSQNYPIVQNLQGQMVHQAISPRTLNAWVKVIEEKAFSPEVIPMFTALSEGATPQDLNTMLNTVGGHQAAMQMLKETINEEAAEWDRLHPVHAGPIAPGQMREPRGSDIAGTTSNLQEQIGWMTSNPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTNPATIMMQKGNFRNQRKTVKCFNCGKEGHIARNCRAPRKRGCWKCGKEGHQMKDCTERQANFLGKIWPSSKGRPGNFLQSRPEPSAPPEESLRLGGETTTPSQRQEPIDRELYPLASLKSLFGNDPSSQ

SEQ ID NO: 615 - protein, 512 aa, Human immunodeficiency virus
  variant (447)..(447): Xaa can be any naturally occurring amino acid
  variant (478)..(478): Xaa can be any naturally occurring amino acid
  variant (484)..(484): Xaa can be any naturally occurring amino acid
MGARASVLSGGQLDKWEKIRLRPGGKKRYQLKHIVWASRELERFSINPGLLETSEGCRQILGQLQPSLQTGSEELKSLYNAVAVLYCVHQNIEVKDTKEALDKIEEEQNKSKKKAQQAAAAAADTGNSSQSSQNYPIVQNVQGQMVYQSISPRTLNAWVKVIEEKAFSPEVIPMFSALSEGATPSDLNLMLNTVGGHQAAMQMLKETINEEAAEWDRTHPVHAGPVAPGQMREPRGSDIAGTTSTLQEQIAWMTGNPVIPVGDIYKRWIILGLNKIVRMYSPTSILDIKQGPKEPFRDYVDRFYKVLRAEQASQDVKNWMTETLLVQNANPDCKTILKALGPAATLEEMMTACQGVGGPSHKARVLAEAMSQVTNSATIMMQRGNPRNQRKIIKCFNCGKEGHIARNCKAPRKKGCWKCGREGHQMKECTERQANFLGKIWPSHKGXPGNFLQSRPEPTAPPAESLPTAPPVESFRFXEETTTXSQKQGPIDKELYPLASLRSLFGNDPSSQ

SEQ ID NO: 616 - protein, 500 aa, Human immunodeficiency virus
MGARASVLSGGKLDTWEKIRLRPGGKKTYKLKHIVWASRELERFALNPGLLETAEGCRQILGQLQPSLQTGSEELKSLHNAVAVLYCVHQRIEVRDTKEALDKIEEEQNKSKKKAQQAAADTGSSSQVSQNYPIVQNIQGQMVHQAISPRTLNAWVKVIEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKIIKCFNCGKEGHLARNCKAPRKRGCWKCGKEGHQMKDCTERQANFLGKIWPSQKGRPGNFLQSRPEPSAPPEESFRFGEETITPPQKQEPIDKDRHPLTSLRSLFGNDPSSQ

SEQ ID NO: 617 - protein, 499 aa, Human immunodeficiency virus
MGARASVLSGGKLDKWEKIQLRPGGKKRYKLKHIVWASRELERFALNPGLLETGEGCRQLLGQLQPALQTGSEELKSLHNTVATLYCVHQGIEVRDTKEALDKIEEEQNKSKKKAQQAAADPGNSSQVSQNYPIVQNLQGQMVHQSLSPRTLNAWVKVIEEKAFSPEVIPMFSALSEGATPTDLNTMLNTVGGHQAAMQMLKETINEEAAEWDRLHPVHAGPIAPGQMREPRGSDIAGTTSTLQEQIGWMTNNPPIPVGDIYKRWIILGLNKIVRMYSPVSILDIKQGPKEPFRDYVDRFYKTLRAEQASQDVKNWMTETLLVQNANPDCKTILKALGPAATLEEMMTACQGVGGPGHKARVLAEAMSQVTNSNTVMMQRGNFRNQRKIVKCFNCGKEGHIARNCRAPRKKGCWKCGKEGHQMKDCTERQANFLGKIWPSYKGRPGNFLQSRPEPSAPPAESFRFGEETTPSQKQEQIDKEMYPLASLKSLFGNDPSSQ

SEQ ID NO: 618 - protein, 500 aa, Human immunodeficiency virus
  variant (28)..(28): Xaa can be any naturally occurring amino acid
  variant (55)..(55): Xaa can be any naturally occurring amino acid
  variant (68)..(68): Xaa can be any naturally occurring amino acid
  variant (161)..(161): Xaa can be any naturally occurring amino acid
  variant (267)..(267): Xaa can be any naturally occurring amino acid
  variant (295)..(295): Xaa can be any naturally occurring amino acid
  variant (385)..(385): Xaa can be any naturally occurring amino acid
  variant (388)..(388): Xaa can be any naturally occurring amino acid
  variant (460)..(460): Xaa can be any naturally occurring amino acid
MGARASVLSGGKLDQWEKIRLRPGGKKXYKLKHIVWASRELERFALNPGLLETAXGCRQILGQLQPAXQTGTEEIRSLYNTVVTLYCVHQRIEVKDTNEALEKIKEEQNKSKKETQQAAADTGKSNQVSQNYPVVQNMQGQMVHQPVSPRTLNAWVKVVEXKAFSPEVIPMFSALAEGATPQDLNTMLNTVGGHQAAMQMLKETINEEAAEWDRLHPVHAGPIAPGQMREPRGSDIAGTTSTLQEQIGWMTNNPPIPVGEIYKRWIXLGLNKIVRMYSPTSILDIKQGPKEPFRXYVDRFYKTLRAEQASQEVKNWMTETLLVQNSNPDCKTILKALGPGATLEEMMTACQGVGGPSHKARVLAEAMSQATSASAMMMQRGNFRXQRXIVKCFNCGKEGHIAKNCRAPRKKGCWKCGKEGHLMKECTERQANFLGKIWPSHKGRPGNFLQSRPEPTAPPXESFRFGEETTTPPQKQEPIDKELYPLSSLKSLFGNDPSSQ

SEQ ID NO: 619 - protein, 500 aa, Human immunodeficiency virus
  variant (8)..(8): Xaa can be any naturally occurring amino acid
  variant (15)..(15): Xaa can be any naturally occurring amino acid
  variant (44)..(44): Xaa can be any naturally occurring amino acid
  variant (128)..(128): Xaa can be any naturally occurring amino acid
  variant (138)..(138): Xaa can be any naturally occurring amino acid
  variant (167)..(167): Xaa can be any naturally occurring amino acid
  variant (177)..(177): Xaa can be any naturally occurring amino acid
  variant (306)..(306): Xaa can be any naturally occurring amino acid
  variant (334)..(334): Xaa can be any naturally occurring amino acid
  variant (478)..(478): Xaa can be any naturally occurring amino acid
  variant (490)..(490): Xaa can be any naturally occurring amino acid
  variant (495)..(495): Xaa can be any naturally occurring amino acid
  variant (499)..(499): Xaa can be any naturally occurring amino acid
MGARASVXSGGKLDXWEKIRLRPGGKKQYQLKHIVWASRELERXALNPGLLETSEGCRQILGQLQSSLQTGSEELKSLYNTVATLYCVHQNIDVRDTKEALDKIEEEQNKGKKNAQQAAANTGNNIPXSQNYPIVQNXQGQMVHQALSPRTLNAWVKVIEEKAFSPXVIPMFSALSXGATPQDLNTMLNTVGGHQAAMQMLKETINEEAAEWDRLHPVHAGPIAPGQMREPRGSDIAGTTSTLQEQIAWMTNNPPIPVGEIYKRWIILGLNKIVRMYSPVSILDIRQGPKEPFRDYVDRFYKTLRXEQATQEVKNWMTETLLVQNANPDCKTIXKALGPGASLEEMMTACQGVGGPGHKARVLAEAMSQVTNPATIMLQKGNFRNQRKTVKCFNCGKEGHIARNCRAPRKKGCWKCGKEGHQMKECTERQANFLGKIWPSHKGRPGNFLQSRPEPTAPPEESFRFGEETTTPSQKPEXKDKEMYPLASLXSLFGXDPSXQ

SEQ ID NO: 620 - protein, 498 aa, Human immunodeficiency virus
  variant (64)..(64): Xaa can be any naturally occurring amino acid
  variant (73)..(73): Xaa can be any naturally occurring amino acid
  variant (90)..(90): Xaa can be any naturally occurring amino acid
  variant (95)..(95): Xaa can be any naturally occurring amino acid
  variant (118)..(118): Xaa can be any naturally occurring amino acid
  variant (460)..(460): Xaa can be any naturally occurring amino acid
MGARASVLSGGQLDKWERIRLRPGGKKQYRLKHIVWASRELERFAVNPGLLETAEGCKQILGQXQPALQTGSXELKSLYNTVATLYCVHXQIDVXDTKEALEKIEEEQNKSKKKAQQXAADTRNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVTNSTSIMMQGGSMRNQRKIVKCFNCGKVGHIAKNCRAPRKRGCWRCGKEGHQMKDCSEKQANFLGKIWPSHKGRPGNFAQNRLEPTAPPXESFRFGEETTTPSQKQQIDKDNPLASLRSLFGNDPSSQ

SEQ ID NO: 621 - protein, 500 aa, Human immunodeficiency virus
  variant (62)..(62): Xaa can be any naturally occurring amino acid
  variant (75)..(75): Xaa can be any naturally occurring amino acid
  variant (91)..(91): Xaa can be any naturally occurring amino acid
  variant (93)..(93): Xaa can be any naturally occurring amino acid
  variant (476)..(476): Xaa can be any naturally occurring amino acid
  variant (478)..(478): Xaa can be any naturally occurring amino acid
MGARASVLSGGELDRWEKIRLRPGGKKQYKLKHIVWASRELERFAVNPGLLETSEGCRQILXQLQPALQTGSEEXRSLFNTVAVLYCVHQXIXVKDTKEALDKIEEEQNKSKKKAQQTAAGTGNSSQVSQNYPIVQNLQGQMVHQAISPRTLNAWVKVVEEKAFSPEVIPMFAALSEGATPQDLNTMLNTVGGHQAAMQILKETINEEAAEWDRLHPVHAGPIAPGQMREPRGSDIAGTTSTLQEQIGWMTNNPPIPVGEIYKKWIILGLNKIVRMYSPTSILDIRQGPKEPFRDYVDRFYRTLRAEQASQDVKNWMTETLLVQNANPDCKTILKALGPAATLEEMMTACQGVGGPGHKARVLAEAMSQVTNSATIMMQKSNFRNQRKTVKCFNCGKEGHIARNCRAPRKKGCWKCGKEGHQMKDCTERQANFLGKIWPSYKGRPGNFLQSRPEPTAPPEESFRFGEETTTPPQKXEXIDKELYPLASLKSLFGNDPSSQ

SEQ ID NO: 622 - protein, 500 aa, Human immunodeficiency virus
MGARASVLSGGELDRWEKIRLRPGGKKKYKLKHIVWASRELERFAVNPSLLETSEGCRQILGQLHPSLQTGSEELKSLYNTVAVLYCVHQRIEIKDTKEALDKIEEEQNKSKKKAQQTAADTGSNSQVSQNYPIVQNLQGQMVHQPISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIGWMTNNPPIPVGDIYKRWIILGLNKIVRMYSPTSILDIKQGPKEPFRDYVDRFYKTLRAEQASQEVKGWMTETLLVQNANPDCKTILKALGPAATLEEMMTACQGVGGPGHKARVLAEAMSQVTNSATVMMQKGNFRSQRRIVKCFNCGKEGHIAKNCRAPRKKGCWKCGKEGHQLKDCTERQANFLGKIWPSYKGRPGNFLQSRPEPTAPPEESFRFGEETTTPPQKQEPIDKEMYPLASLKSLFGNDPLSQ

SEQ ID NO: 623 - protein, 499 aa, Human immunodeficiency virus
MGARASVLSGGELDKWEKIRLRPGGKKKYKLKHIVWASRELERFAVNPGLLETSEGCRQILGQLQPSLQTGSEELGSLYNTMAVLYCVHQRIDVKDTKEALDKIEEEQNKSKKKAQQAAAGTGNSSQVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGDIYKKWIILGLNKIVRMYSPTSILDIKQGPKEPFRDYVDRFYKTLRAEQASQEVKNWMTETLLVQNANPDCKTILKALGPGATLEEMMTACQGVGGPGHKARVLAEAMSQVTNPSTIMIQKGNFRNQRKTVKCFNCGKEGHIAKNCRAPRKKGCWKCGKEGHQMKDCTERQANFLGKIRPSHKGRPGNFPQSRTEPTAPPEENFRFGEETTPPQKQEPIDKELYPLASLKSLFGNDPLSQ

SEQ ID NO: 624 - protein, 509 aa, Human immunodeficiency virus
MGARASVLSGGELDRWEKIRLRPGGRKKYRLKHVVWASRELERFAVNPGLLETSEGCRQILGQLQPSLQTGSEELRSLYNTIAVLYCVHRKIEVKDTKEALDKIEEEQNKSKKKAQPAAADTGNSSQATPGGPVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNANPDCKTILKALGPAATLEEMMTACQGVGGPSHKARVLAEAMSQVNQATIMMQKGNFRNQRKIVKCFNCGKEGHIARNCKAPRKRGCWKCGKDGHQMKDCTERQANFLGKIWPSHKGRPGNFLQNRPESRPEPSAPPEESFRFGEETAFPSQKQEPIDKELYPLVSLKSLFGNDPSSQ

SEQ ID NO: 625 - protein, 504 aa, Human immunodeficiency virus
MGARASVLSGGKLDRWEKIRLRPGGKKKYQLKHIVWASRELERFAVNPSLVETSEGCRQILRQLQPSLQTGSEELKSLYNTIAVLYCVHQNIEVKDTKEALDKIEEEQNKSEKKAQQAAADTNNNSPVSQNFPIVQNLQGQMVHQAISPRTLNAWVKVVEEKAFSPEVIPMFAALSEGATPQDLNTMLNTVGGHQAAMQMLKETINEEAAEWDRLHPVHAGPIAPGQMREPRGSDIAGTTSTLQEQIGWMTSNPAVPVGEIYKRWIIMGLNKVVRMYSPTSILDIKQGPKEPFRDYVDRFYKTLRAEQASQEVKNWMTETLLVQNSNPDCKTILKALGPAATLEEMMTACQGVGGPSHKAKILAEAMSQVTNSATIMMQRGNFKGQRKTVKCFNCGKEGHVAKNCRAPRKKGCWKCGREGHQMKDCTERQANFLGKIWPSHKGRPGNFLQNRPESRLEPTAPPAESFRFGEETTTPSQKQEQTDKELYPLASLRSLFGNDPSSQ

SEQ ID NO: 626 - protein, 500 aa, Human immunodeficiency virus
MGARASVLSGGELDRWEKIRLRPGGKKKYRLKHIVWASRELERFAVNPSLLETAEGCRQILGQLQPALQTGSEELKSLFNTVAVLYCVHQRIEVKDTKEALDKIEEEQNKSKKKAQQAAADTGNSSQVSQNYPIVQNMQGQMIHQAISPRTLNAWVKVIEEKAFSPEVIPMFSALSEGATPHDLNTMLNAVGGHQAAMQMLKETINEEAAEWDRLHPVHAGPVAPGQMREPRGSDIAGTTSTLQEQIGWMTSNPPIPVGEVYKKWIIMGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTSPATIMMQKGNFRNPRKSVKCFNCGKEGHIAKNCRAPRKKGCWKCGREGHQMKDCTERQANFLGKIWPSYKGRPGNFLQSRLEPTAPLEESFRFREETTTPSQKQEPIDKEQYPLTSLRSLFGNDPSSQ

SEQ ID NO: 627 - protein, 500 aa, Human immunodeficiency virus
  variant (12)..(12): Xaa can be any naturally occurring amino acid
  variant (67)..(67): Xaa can be any naturally occurring amino acid
  variant (223)..(223): Xaa can be any naturally occurring amino acid
  variant (292)..(292): Xaa can be any naturally occurring amino acid
  variant (326)..(326): Xaa can be any naturally occurring amino acid
  variant (442)..(442): Xaa can be any naturally occurring amino acid
  variant (447)..(447): Xaa can be any naturally occurring amino acid
  variant (452)..(452): Xaa can be any naturally occurring amino acid
  variant (467)..(467): Xaa can be any naturally occurring amino acid
MGARASVLSGGXLDRWEKIRLRPGGKKKYKLKHIVWASRELERFAVNPGLLETSGGCRKILEQLQPXLQTGSEELKSLYNTVATLYCVHQRIDVKDTKEALDKIEEEQNKSKKKAQQAAADTVNSSQVSQNYPIVQNLQGQMVHQPLSPRTLNAWVKVVEEKAFSPEVIPMFTALSEGATPQDLNTMLNTVGGHQAAMQMLKETINEEAAEWDRLHPVHAGPXAPGQMREPRGSDIAGTTSTLQEQIGWMTNNPPIPVGEIYKRWIILGLNKIVRMYSPTSILDIKQGPKEXFRDYVDRFYKTLRAEQASQDVKNWMTETLLVQNXNPDCKTILKALGPAATLEEMMTACQGVGGPGHKARVLAEAMSHIQNSNTIMMQRGNFRNQRKIVKCFNCGKEGHIAKNCRAPRKRGCWKCGKEGHQMKDCTERQANFLGKIWPSHXGRPGXFLQSXPEPTAPPEESFRSGXGTTTLPQKQEPIDKEQYPLTSLRSLFGNDPLSQ

SEQ ID NO: 628 - protein, 510 aa, Human immunodeficiency virus
  variant (226)..(226): Xaa can be any naturally occurring amino acid
  variant (466)..(466): Xaa can be any naturally occurring amino acid
MGARASVLSAGELDRWERIRLRPGGKKKYRLKHIVWASRELERFAVNPGLLETSEGCKQILGQIQPSLQTGSEELRSLYNTVAVLYCVHQKIEIKDTKEALEKIEKEQNNSQKKVQQVAAGTGNSSQVSQNYPIVQNLQGQMVHQPLTPRTLNAWVKVVEEKAFSPEVIPMFSALSEGATPQDLNTMLNTVGGHQAAMQMLKETINEEAADWDRVHPVQAGPVAPXQIRDPRGSDIAGTTSTLQEQITWMTSNPPIPVGEIYKRWIILGLNKIVRMYSPVSILDIRQGPKEPFRDYVDRFYKTLRAEQASQDVKNWMTETLLVQNANPDCKTILKALGPAASLEEMMTACQGVGGPGHKARVLAEAMSQVTSTSAIMMQKGNYRIQRKTVKCFNCGKEGHIARNCRAPRKKGCWKCGREGHQMKDCTERQANFLGKIWPSHKGRPGNFLQNRPEPSAPAEPSAPPXESFRFGEGTTTPSRGQEPTDKSQEPTDKGLYPLASLRSLFGSDP

SEQ ID NO: 629 - protein, 503 aa, Human immunodeficiency virus
  variant (371)..(371): Xaa can be any naturally occurring amino acid
MGARASVLSGGELDRWEKIRLRPGGKKKYKLKHIVWASRELERFALNPGLLETSEGCRQILEQLQPSLQTGSEEIKSLFNTVATLYCVHQRIEVKDTKEALEKIEEEQAKSKKKAQQAAAANTGNSSQVSQNYPIVQNLQGQMVHQPLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQXTNSASAAIMMQRGNFKNQRKTVKCFNCGKEGHIARNCRAPRKKGCWKCGREGHQMKDCTERQANFLGKIWPSYKGRPGNFLQSRPEPTAPPEESFRFGEETTAPSQKQETIDKELYPLASLKSLFGNDPSSQ

SEQ ID NO: 630 - protein, 499 aa, Human immunodeficiency virus
  variant (4)..(4): Xaa can be any naturally occurring amino acid
  variant (26)..(26): Xaa can be any naturally occurring amino acid
  variant (30)..(30): Xaa can be any naturally occurring amino acid
  variant (64)..(64): Xaa can be any naturally occurring amino acid
  variant (138)..(138): Xaa can be any naturally occurring amino acid
  variant (147)..(147): Xaa can be any naturally occurring amino acid
  variant (334)..(334): Xaa can be any naturally occurring amino acid
  variant (463)..(463): Xaa can be any naturally occurring amino acid
  variant (476)..(476): Xaa can be any naturally occurring amino acid
  variant (485)..(485): Xaa can be any naturally occurring amino acid
MGAXASVLSGGELDRWEKIRLRPGGXKTYXLKHIVWASRELERFAVNPGLLETAAGCRQILGQXQPSLQTGSEELKSLYNTIATLYCVHQKIEVRDTKEALDKIEEEQNRSKKKAQQAAADKENSSQVSQNYPIVQNXQGQMVHQAXSPRTLNAWVKVVEEKAFSPEVIPMFSALAEGATPQDLNTMLNTVGGHQAAMQMLKETINEEAAEWDRLHPVHAGPIAPGQMREPRGSDIAGTTSSLQEQIGWMTNNPPIPVGEIYKRWIIMGLNKIVRMYSPVSILDIRQGPKEPFRDYVDRFYKTLRAEQASQDVKNWMTETLLVQNANPDCKTIXKALGPAATLEEMMTACQGVGGPGHKARVLAEAMSQVTNPTIMMQRGNYRSTRKTVKCFNCGKEGHIARNCRAPRKKGCWKCGKEGHQMKECTERQANFLGKIWPSHKGRPGNFLQSRPEPTAPPEESFXVREETATPSQKQXTIDKELYPXTSLRSLFGNDPSSQ

SEQ ID NO: 631 - protein, 500 aa, Human immunodeficiency virus
  variant (463)..(463): Xaa can be any naturally occurring amino acid
MGARASVLSGGELDRWEKIRLRPGGNKKYKLKHIVWASRELERFAVNPGLLETAEGCRQILGQLQPALQTGSEELRSLYNTVATLYCVHQKIDIKDTKEALDKIEEEQNKSKKKAQQAAAADTGNNSQVSQNYPIVQNLQGQMVHQAISPRTLNAWVKVVEEKAFSPEVIPMFTALSEGATPQDLNTMLNTVGGHQAAMQMLKETINEEAAEWDRLHPVQAGPIAPGQLREPRGSDIAGTTSNLQEQIGWMTSNPPIPVGEIYKRWIILGLNKIVRMYSPSSILDIKQGPKEPFRDYVDRFYKTLRAEQASQDVKNWMTETLLVQNANPDCKTILKALGPAATLEEMMTACQGVGGPGHKARVLAEAMSQVTNNTNIMMQRGNFRNPRKIAKCFNCGKEGHIARNCRAPRKKGCWKCGKEGHQMKDCTERQANFLGRIWPSHKGRPGNFLQNRTEPTAPPAEXFRFGEETTPSQKQEQTDKDLYPLASLRSLFGNDPSLL

SEQ ID NO: 632 - protein, 499 aa, Human immunodeficiency virus
MGARASVLSGGQLDRWEKIHLRPGGKKRYQLKHIVWASRELERFAINPSLLETSEGCRQILGQLQPSLQTGSEEIKSLFNTVATLYCVHQRIEVKDTKEALDKIEEEQNKSKQAAAAAADTGNSSQVSQNYPIVQNMQGQMVHQPLTPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSATIMMQKGNFKNQRKIVKCFNCGKEGHIARNCRAPRKRGCWKCGKEGHQMKECTERQANFLGKIWPSHKGRPGNFLQSRPEPSAPPAESFGFGEETTTPSQKQEPIDREMYPLSSLKSLFGNDPSSQ

SEQ ID NO: 633 - protein, 503 aa, Human immunodeficiency virus
MGARASVLSGGKLDKWEKIRLRPGGKKRYQLKHIVWASRELERFAVNPALLETSEGCRQIIGQLQPALQTGSEELKSLYNTVAVLYCVHQNIEIKDTKEALDKIEEEQNKSKKKAQQAAADTGNSSQVSQNYPIVQNLQGQMVHQPISPRTLNAWVKVVEEKAFSPEVIPMFSALAEGATPQDLNTMLNTVGGHQAAMQMLKETINEEAAEWDRLHPVPAGPIAPGQMRDPRGSDIAGTTSNLQEQIGWMTGNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPSHKARVLAEAMSQATNPNIIMMQRGNFRNQRKIVKCFNCGKEGHIAKNCRAPRKKGCWKCGKDGHQMKDCTERQANFLGKIWPSHKGRPGNFLQSRSEQSRLEPTAPPAPPEESFRFGEATPPQKQEPIDKERYPLTSLRSLFGNDP

SEQ ID NO: 634 - protein, 499 aa, Human immunodeficiency virus
MGARASVLSGGELDKWEKIRLRPGGKKKYKLKHIVWASRELERFAVNPGLLETSDGCRQILGQLQPSLQTGSEELRSLYNTVATLYCVHQRIEVKDTKEALENIEEEQNKSKKKAQPADDTGNSSQVSQNYPVVQNLQGQMVHQPISPRTLNAWVKVVEEKAFSPEVIPMFTALSEGATPQDLNTMLNTVGGHQAAMQMLKETINEEAAEWDRLHPVHAGPIAPDQMREPRGSDIAGITSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNSATIMMQRGNFRNQRKIVKCFNCGKEGHITKNCRAPRKKGCWKCGKEGHQMKDCTERQANFLGKIWPSKKGRPGNFLQSRPEPTAPPAESFRFGEETTTPSQKQEPTDKELYPLASLRSLFGNDPSSQ

SEQ ID NO: 635 - protein, 504 aa, Human immunodeficiency virus
  variant (327)..(327): Xaa can be any naturally occurring amino acid
  variant (392)..(392): Xaa can be any naturally occurring amino acid
  variant (405)..(405): Xaa can be any naturally occurring amino acid
  variant (413)..(413): Xaa can be any naturally occurring amino acid
  variant (416)..(416): Xaa can be any naturally occurring amino acid
MGARASILSGGKLDRWEKIRLRPGGKKSYKLKHLVWASRELERFAVNPGLLETSEGCRQILGQLQPSLQTGSEELKSLFNTIATLYCVHQGIDVKDTKEALDKIEEEQNKSKKKAQQAAADAGENKLVSQNFPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNWMTETLLVQNAXPDCKTILKALGPAATLEEMMTACQGVGGPGHKARVLAEAMSQVTNSAAVMMQRGNFRNQRKAVKXFNCGKEGHIARNXRAPRKKGXWKXGKEGHQMKDCTERQANFLGKIWPSHKGRPGNFLQSRPESRPEPTAPPEESFSFGEETGIPSQKQGTIDKELYPLTSLRSLFGNDPSSQ

SEQ ID NO: 636 - protein, 498 aa, Human immunodeficiency virus
  variant (45)..(45): Xaa can be any naturally occurring amino acid
  variant (103)..(103): Xaa can be any naturally occurring amino acid
  variant (115)..(115): Xaa can be any naturally occurring amino acid
  variant (306)..(306): Xaa can be any naturally occurring amino acid
  variant (389)..(389): Xaa can be any naturally occurring amino acid
  variant (397)..(397): Xaa can be any naturally occurring amino acid
  variant (404)..(404): Xaa can be any naturally occurring amino acid
  variant (407)..(407): Xaa can be any naturally occurring amino acid
  variant (467)..(467): Xaa can be any naturally occurring amino acid
  variant (487)..(487): Xaa can be any naturally occurring amino acid
MGARASVLSGGELDKWEKIQLRPGGKKRYKLKHIVWASRELERFXVNPGLLETSGGCRQILEQLEPALKTGSEELKSLYNTVATLYCVHQKIEVRDTKEALDXIEEERNKSKKKXQQAAADAGNNSSQVSQNYPIVQNIQGQMVHQAISPRTLNAWVKVVEEKAFSPEVIPMFSALSEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIKQGPKEPFRDYVDRFYKTLXAEQASQEVKNWMTETLLVQNANPDCKTILKALGPAATLEEMMTACQGVGGPGHKARVLAEAMSQVTNATTIMMQKGNYRNQRXTVKCFNCXKEGHIAXNCXAPRKKGCWKCGQEGHQMKDCTGRQANFLGKIWPSHKGRPGNFLQSRPEPTAPPEESFRFXEETTTPPQKQEPRDRELYPXASLRSLFGNDP

SEQ ID NO: 637 - protein, 500 aa, Human immunodeficiency virus
  variant (26)..(26): Xaa can be any naturally occurring amino acid
  variant (57)..(57): Xaa can be any naturally occurring amino acid
  variant (67)..(67): Xaa can be any naturally occurring amino acid
  variant (128)..(128): Xaa can be any naturally occurring amino acid
  variant (140)..(140): Xaa can be any naturally occurring amino acid
  variant (227)..(227): Xaa can be any naturally occurring amino acid
  variant (280)..(280): Xaa can be any naturally occurring amino acid
  variant (423)..(423): Xaa can be any naturally occurring amino acid
  variant (427)..(427): Xaa can be any naturally occurring amino acid
MGARASVLSAGELDRWEKIRLRPGGXKKYRLKHIVWASRELERFAVNPGLLETSEGXRQILGQLQPXLQTGSEELRSLFNTVAVLYCVHQKIEVKDTKEALDKIEEEQNKSKKKAQQAVADTGNSNQXSQNYPIVQNMQXQMVHQALSPRTLNAWVKVVEEKAFSPEVIPMFTALSEGATPQDLNTMLNTVGGHQAAMQMLKETINEEAAEWDRLHPVQAGPVAPGXMREPRGSDIAGTTSTLQEQIGWMTNNPPIPVGEIYKRWIIMGLNKIVRMYSPXSILDIKQGPKEPFRDYVDRFYKTLRAEQASQEVKNWMTDTLLIQNSNPDCKTILKALGPAATLEEMMTACQGVGGPSHKARVLAEAMSQVTHPPTIMVQNGKFRNQRKTVKCFNCGKEGHIARNCRAPRKKGCWKCGKEGHQXKDCXERQANFLGRIWPSHKGRPGNFVQSRPEPTAPPEESFRFGEETTTPSQKQEPTDKELYPLASLKSLFGNDPSCQ

SEQ ID NO: 638 - protein, 501 aa, Human immunodeficiency virus
MGARASVLSGGELDKWEKIRLRPGGKKKYQLKHIIWASRELERFAVNPGLLETSEGCRQILGQLQSSLQTGSEELRSLYNTVATLYCVHQKIEVKDTKEALEKIEEEQNKSKKKAQQAVAAAGTGNSSQVSQNFPIVQNLQGQMVHQALSPRTLNAWVKVVEEKAFSPEVIPMFTALSEGVTPQDLNTMLNTVGGHQAAMQMLKETINEEAAEWDRLHPVHAGPVAPGQMREPRGSDIAGTTSNLQEQVAWMTSNPPIPVGEIYKRWIILGLNKIVRMYSPTSILDIKQGPKEPFRDYVDRFYKTLRAEQASQEVKNWMTETLLVQNSNPDCKTILKALGPGATLEDMMTACQGVGGPGHKARVLAEAMSQANSASIMMQRGNFRNQRKTVKCFNCGKEGHIAKNCRAPRKKGCWKCGKEGHQMKDCTERQVNFLGKIWPSHKGRPGNFLQSRPEPTAPPAESFRFGEETKTPPQKQEPTDKELYPLASLKSLFGNDPSSQ

SEQ ID NO: 639 - protein, 498 aa, Human immunodeficiency virus
  variant (21)..(21): Xaa can be any naturally occurring amino acid
  variant (46)..(46): Xaa can be any naturally occurring amino acid
  variant (61)..(61): Xaa can be any naturally occurring amino acid
  variant (63)..(63): Xaa can be any naturally occurring amino acid
  variant (67)..(67): Xaa can be any naturally occurring amino acid
  variant (80)..(80): Xaa can be any naturally occurring amino acid
  variant (84)..(84): Xaa can be any naturally occurring amino acid
  variant (91)..(91): Xaa can be any naturally occurring amino acid
  variant (133)..(133): Xaa can be any naturally occurring amino acid
  variant (164)..(164): Xaa can be any naturally occurring amino acid
  variant (170)..(170): Xaa can be any naturally occurring amino acid
  variant (238)..(238): Xaa can be any naturally occurring amino acid
  variant (448)..(448): Xaa can be any naturally occurring amino acid
  variant (451)..(451): Xaa can be any naturally occurring amino acid
  variant (461)..(461): Xaa can be any naturally occurring amino acid
  variant (465)..(465): Xaa can be any naturally occurring amino acid
MGARASVLSPGELDKWEGIRXRPGGKKKYRLKHIVWASRELERFAXNPGLLETAGGCKQIXEXLLPXLQTGSEGFRSLYXTVAXLYCVHKXIEIRDTKEALDKIEEEQNNSKKRAQQAAAGTGNSSQVSQNYXIVQNLQGQMVHQPISPRTLNAWVKVVEEKAXSPEVIXMFTALSEGATPQDLNTMLNTVGGHQAAMQMLKETINEEAAEWDRLHPAQAGPIAPGQIRDPRGSDIAXTTSTLQEQITWMTANPAIPVGEIYKRWIILGLNKIVRMYSPTSILDIRQGPKEPFRDYVDRFYKTLRAEQASQDVKNWMTETLLVQNANPDCRTILKALGPAATLEEMMTACQGVGGPGHKARILAEAMSQVTNSANTTIMMQKGNFRKTIKCFNCGKEGHLARNCRAPRKKGCWKCGKEGHQMKDCTERQRQANFLGKIWPSHKGRPGXFLXSRPEPTAPPXESFXFQEETTTPPRKQEPIDKDQYPLASLKSLFGNDP

SEQ ID NO: 640 - protein, 498 aa, Human immunodeficiency virus
  variant (88)..(88): Xaa can be any naturally occurring amino acid
  variant (374)..(374): Xaa can be any naturally occurring amino acid
MGARASVLSGGKLDKWEKIRLRPGGKKKYQLKHIVWASRELERFAVNPGLLETSEGCRQILGQLQPALQTGSEDFRSLYNTIATLYCXHQNIDIKDTKEALDKIEEEQNKSKKRAQQAAADAGNKSQISQNYPIVQNIQGQMVHQAISPRTLNAWVKVVEEKAFSPEVIPMFTALSEGATPQDLNTMLNTVGGHQAAMQMLKETINEEAAEWDRLHPVHAGPVAPGQMREPRGSDIAGTTSTLQEQIGWMTNNPPIPVGEIYKRWIILGLNKIVRMYSPASILDIKQGPKEPFRDYVDRFYKTLRAEQASQEVKNWMTETLLVQNANPDCKTILKALGPAASLEEMMTACQGVGGPSHKARVLAEAMSQVTNTXTVMMQKGNFKNQRKIVKCFNCGKEGHIAKNCRAPRKRGCWKCGKEGHQMKDCTERQANFLGKIWPSHKGRPGNFLQSRPEPSAPPEEIFRFGEETTTPSQKQIDKEQCPLASLKSLFGNDPLSQ

SEQ ID NO: 641 - protein, 505 aa, Human immunodeficiency virus
  variant (133)..(133): Xaa can be any naturally occurring amino acid
  variant (175)..(175): Xaa can be any naturally occurring amino acid
  variant (189)..(189): Xaa can be any naturally occurring amino acid
  variant (271)..(271): Xaa can be any naturally occurring amino acid
  variant (303)..(303): Xaa can be any naturally occurring amino acid
MGARASVLSGGGLDRWKKIRLRPGGKKKYKLKHIVWASRELERFAVNPGLLETSEGCRQILEQLQPSLQTGSEELKSLYNTIAVLYCVHQKIDVKDTKEALDKIEEEQSKSKKKKAQQAAAAADTGNSSQVSXNYPIVQNIQGQMVHQALSPRTLNAWVKVVEEKAFSPEVIPMXTALSEGATPQDLNXMLNTVGGHQAAMQMLKETINEEAAEWDRLHPVHAGPIAPGQMREPRGSDIAGTTSTLQEQIGWMTNNPPIPVGEIYKRWIIXGLNKIVRMYSPSSILDIKQGPKEPFRDYVDRXYKTLRAEQASQEVKNWMTETLLVQNSNPDCKTILKALGPAATLEEMMTACQGVGGPGHKARVLAEAMSQVTNSATIMMQKGNFRSHRKPVKCFNCGKEGHIARNCRAPRKRGCWKCGKEGHQMKDCTERQANFLGKIWPSHKGRPGNFLQSRPEPTAPPEESFRSGEGTATPAQKQELIDLDKEMYPLTSLRSLFGNDPSSK

SEQ ID NO: 642 - protein, 500 aa, Human immunodeficiency virus
  variant (28)..(28): Xaa can be any naturally occurring amino acid
MGARASVLSGGELDRWEKIRLRPGGKKXYKLKHLVWASRELERFAVNPALLETSEGCRQILGQLQPALQTGSEELKSLYNTVATLYCVHQRIDVKDTKEALDKIEEEQNKSKKRAQQAAADTGNSNQVSQNYPIVQNLQGQMTHQAISPRTLNAWVKVVEEKAFSPEVIPMFSALSEGATPQDLNTMLNTVGGHQAAMQMLKETINEEAAEWDRLHPVHAGPIAPGQMRDPRGSDIAGTTSTLQEQIGWMTNNPPIPVGEIYKRWIILGLNKIVRMYSPASILDIKQGPKESFRDYVDRFYKTLRAEQGSQEVKNWMTETLLVQNANPDCKTILKALGPGATLEEMMTACQGVGGPSHKARILAEAMSQVTNPANIMMQRGNFRNQRRIIKCFNCGKEGHIAKNCRAPRKKGCWKCGGEGHQMKDCTERQANFLGKIWPSHKGRPGNFLQSRPEPSAPPEESFMFGEETAAPSQKQEPIDKEKYPLASLRSLFGNDPLSQ

SEQ ID NO: 643 - protein, 500 aa, Human immunodeficiency virus
  variant (66)..(66): Xaa can be any naturally occurring amino acid
  variant (103)..(103): Xaa can be any naturally occurring amino acid
  variant (124)..(124): Xaa can be any naturally occurring amino acid
  variant (135)..(135): Xaa can be any naturally occurring amino acid
  variant (159)..(159): Xaa can be any naturally occurring amino acid
  variant (257)..(257): Xaa can be any naturally occurring amino acid
  variant (259)..(259): Xaa can be any naturally occurring amino acid
  variant (263)..(263): Xaa can be any naturally occurring amino acid
  variant (268)..(268): Xaa can be any naturally occurring amino acid
  variant (274)..(274): Xaa can be any naturally occurring amino acid
  variant (290)..(290): Xaa can be any naturally occurring amino acid
  variant (312)..(312): Xaa can be any naturally occurring amino acid
  variant (322)..(322): Xaa can be any naturally occurring amino acid
  variant (381)..(381): Xaa can be any naturally occurring amino acid
  variant (383)..(383): Xaa can be any naturally occurring amino acid
  variant (470)..(470): Xaa can be any naturally occurring amino acid
MGARASVLSGGKLDRWEKIQLRPGGKKRYKLKHIVWASRELERFALNPGLLETSEGCRQILGQLQXSLQTGSEELKSLFNAVAVLYCVHQNIEIRDTKEALDXIEEEQNKSKKKAQQAAADTGXSSNVSQNYPIXQNMQGQMVHQAISPRTLNAWVKVXEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIXVXEIYXRWIIXGLNKIXRMYSPISILDIRQGPXEPFRDYVDRFYKTLRAEQASQXVKNWMTETLXVQNANPDCKTILKALGPAATLEEMMTACQGVGGPGHKARVLAEAMSQVTNSTNIMMQRXSXRSQRKTVKCFNCGKEGHIARNCRAPRKKGCWKCGREGHQMKECTERQANFLGKIWPSNKGRPGNFPQSRLEPTAPPEESFRFGEETXTPSQKQEPKDKELYPLASLRSLFGNDPSSQ

SEQ ID NO: 644 - protein, 501 aa, Human immunodeficiency virus
  variant (326)..(326): Xaa can be any naturally occurring amino acid
  variant (363)..(363): Xaa can be any naturally occurring amino acid
  variant (371)..(371): Xaa can be any naturally occurring amino acid
MGARASVLSGGELDRWEKIRLRPGGKKKYKLKHIVWASRELERFAINPGLLETAEGCRQILEQLQPALQTASEEVKSLNNAIAVLYCVHQRIDVKDTKEALEKIEEEQNKSKKRAQQAAAATGNNSQSSQGSQNYPIVQNIQGQMVHQAISPRTLNAWVKVIEEKAFSPEVIPMFSALSEGATPQDLNTMLNTVGGHQAAMQMLKETINEEAAEWDRMHPVHAGPIAPGQMREPRGSDIAGTTSTLQEQIGWMTSNPPIPVGEIYKRWIILGLNKIVRMYSPVSILDIRQGPKEPFRDYVDRFYKTLRAEQASQDVKNWMTETLLXQNANPDCKTILKALGPAATLEEMMTACQGVGGPGHKXRVLAEAMXHVTNSTNIMMQRGNFRNQRKAVKCFNCGKEGHIARNCKAPRKKGCWKCGREGHQMKDCTERQANFLGKIWPSSKGRPGNFLQSRPEPTAPPAESFREEATTPPQRSEPIDKEMYPLASLKSLFGNDPSSQ

SEQ ID NO: 645 - protein, 500 aa, Human immunodeficiency virus
  variant (73)..(73): Xaa can be any naturally occurring amino acid
MGARASVLSGGDLDRWEKIRLRPGGKKQYKLKHIVWASRELERFAVNPGLLETAEGCRQILGQLQPSLQTGSXELRSLFNTIATLYCVHQKIEVKDTKEALEKIEEEQNKSKKKAQQAAAGTGNSSQTSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPSHKARVLAEAMNQVTTSATIMMQKGNFRNQRKTVKCFNCGKEGHIARNCRAPRKKGCWKCGKEGHQMKDCTERQANFLGKIWPSHKGRPGNFLQSRPEPTAPPEESFRFGEETTAPSQKQEPIDKEQYPLASLRSLFGNDPSSQ

SEQ ID NO: 646 - protein, 498 aa, Human immunodeficiency virus
  variant (8)..(8): Xaa can be any naturally occurring amino acid
  variant (21)..(21): Xaa can be any naturally occurring amino acid
  variant (55)..(55): Xaa can be any naturally occurring amino acid
  variant (102)..(102): Xaa can be any naturally occurring amino acid
  variant (110)..(110): Xaa can be any naturally occurring amino acid
  variant (127)..(127): Xaa can be any naturally occurring amino acid
  variant (154)..(154): Xaa can be any naturally occurring amino acid
  variant (205)..(205): Xaa can be any naturally occurring amino acid
  variant (298)..(298): Xaa can be any naturally occurring amino acid
  variant (344)..(344): Xaa can be any naturally occurring amino acid
  variant (383)..(383): Xaa can be any naturally occurring amino acid
  variant (392)..(392): Xaa can be any naturally occurring amino acid
  variant (471)..(471): Xaa can be any naturally occurring amino acid
  variant (481)..(481): Xaa can be any naturally occurring amino acid
MGARASIXSGGELDRWEKIRXRPGGNKKYKLKHIVWASRELERFAVNPGLLETSXGCRQILVQLQPSLQTGSEELKSLYNTIAVLYCVHQRIEVKDTREALXKVEEEQNXSKKKAQQAAADTGSNSXVSQNYPIVQNLQGQAVHQAISPRTLNXWVKVVEEKAFSPEVIPMFSALSEGATPQDLNTMLNTVGGHQAAMQMLKETXNEEAAEWDRLHPVHAGPIAPGQIREPRGSDIAGTTSTLQEQIAWMTNNPPIPVGEIYKRWIILGLNKIVRMYSPSSILDIKQGPKEPFRDYVXRFYKTLRAEQASQEVKNWMTETLLVQNANPDCKTILKALGPAATLXEMMTACQGVGGPGHKARVLAEAMSQVTNSATIMQQGNYXNQRKPVKCXNCGKAGHIAKNCRAPRKKGCWKCGKEGHQMKDCTERQANFLGKIWPSYKGRPGNFLQSRPEPSAPPEESFRFGEETTPXQKQEQIDKEXHPLTSLRSLFGSDPSSQ

SEQ ID NO: 647 - protein, 500 aa, Human immunodeficiency virus
  variant (110)..(110): Xaa can be any naturally occurring amino acid
  variant (137)..(137): Xaa can be any naturally occurring amino acid
  variant (151)..(151): Xaa can be any naturally occurring amino acid
MGARASVLSGGKLDAWEKIRLRPGGKKKYRLKHIVWASRELERFAVNPGLLETSEGCRQILGQLQPSLQTGSEELKSLYNTIAVLYCVHQRIEIKDTKEALDKIEEEQNXSKKKAQHAAADTGNNNSQVSQNYPIVXNAQGQLVHQAMSPXTLNAWVKVVEEKAFSPEVIPMFSALSEGATPQDLNTMLNTVGGHQAAMQMLKETINEEAAEWDRLHPVQAGPVAPGQIREPRGSDIAGTTSNLQEQIAWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPGHKARVLAEAMSQVTPTTVMMQKGNFRSQRRTVKCFNCGKDGHIAKNCRAPRKRGCWKCGKEGHQMKDCTERQANFLGKIWPSHKGRPGNFLQNRPEPSAPPEESFRFGEETTTPSQKQEPIDKELYPTASLRSLFGNDPLSQ

SEQ ID NO: 648 - protein, 503 aa, Human immunodeficiency virus
MGARASILSGGDLDRWERIRLRPGGKKKYQLKHLVWASRELERFAVNPGLLETPEGCRQILSQLQPALQTGSEGFRSLYNAISVLYCVHQRIEVKDTKEALDKIEEEQNKCKKKAQQAAADTGNSSQVSQNYPIVQNIQGQMVHQPISPRTLNAWVKVVEEKAFSPEVIPMFSALSEGATPQDLNTMLNTVGGHQAAMQMLKEVINEEAAEWDRLHPAQAGPVAPGQMRDPRGSDIAGTTSTLQEQIGWMTHNPPIPVGEIYKRWIILGLNKIVRMYSPSSILDIKQGPKEPFRDYVDRFYKTLRAEQASQEVKNWMTETLLVQNSNPDCKTILKALGPAATLEEMMTACQGVGGPSHKARILAEAMSQVTNSATIMMQKGNFRGPRKIIKCFNCGKEGHLAKNCRAPRKRGCWKCGKEGHQMKDCTERQANFLGKIWPSHKGRPGNFLQSRPEPTAPPAPPEESFRFGGETTTPSQKQEQIDKDLYPLDSLRSLFGNDPSSQ

SEQ ID NO: 649 - protein, 500 aa, Human immunodeficiency virus
  variant (215)..(215): Xaa can be any naturally occurring amino acid
  variant (227)..(227): Xaa can be any naturally occurring amino acid
  variant (453)..(453): Xaa can be any naturally occurring amino acid
MGARASVLSGGELDRWEKIRLRPGGKKQYKLKHIVWASRELERFAVNPGLLETSEGCRQILKQLQPSLQTGSEELKSLFNTVATLYCVHQRIDVKDTKEALDKIEEEQNKSKKKAQQAAADTGANNQVSQNYPIVQNLQGQMVHQAISPRTLNAWVKVVEEKAFSPEVIPMFSALSEGATPQDLNTMLNTVGGHQAAMQMLKETINEEAAEWDRXHPVHAGPIAPGXMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPGATLEEMMTACQGVGGPGHKARVLAEAMSQVTGPANIMMQRGNFRNQGKTVKCFNCGKEGHIARNCRAPRKKGCWKCGREGHQMKDCTERQANFLGKIWPSHKGRPGNFLQNRXEPSAPPEESFRFGEETATPPQRQEPINKELYPLASLKSLFGNDPSSQ

SEQ ID NO: 650 - protein, 500 aa, Human immunodeficiency virus
  variant (280)..(280): Xaa can be any naturally occurring amino acid
  variant (372)..(372): Xaa can be any naturally occurring amino acid
  variant (499)..(499): Xaa can be any naturally occurring amino acid
MGARASVLSGGELDRWEKIRLRPGGKKKYRLKHIVWASRELERFAVNPGLLETAAGCRQILGQLQPALQTGSEEFKSLYNTIATLYCVHQKIDIRDTKEALDKIEEEQNKSKKKAQQTAADTGNSNQVSQNYPIVQNLQGQMVHQPLSPRTLNAWVKVVEEKAFSPEVIPMFSALSEGATPQDLNTMLNTVGGHQAAMQMLKEAINEEAAEWDRLHPVHAGPIAPGQMREPRGSDIAGTTSTLQEQIGWMTNNPPIPVGEIYKRWIILGLNKIVRMYSPXSILDIRQGPKEPFRDYVDRFYKTLRAEQASQEVKNWMTETLLVQNANPDCKTILKALGPAATLEEMMTACQGVGGPGHKARVLAEAMSQVTXPATIMMQKGKFRNQRKIVKCFNCGKEGHIAKNCRAPRKKGCWKCGKEGHQMKDCTERQANFLGKIWPSHKGRPGNFLQSRPEPTAPPEESFRFGEETTTPPQKQEPIDKELYPLASLKSLFGNDPSXQ

SEQ ID NO: 651 - protein, 503 aa, Human immunodeficiency virus
  variant (12)..(12): Xaa can be any naturally occurring amino acid
  variant (34)..(34): Xaa can be any naturally occurring amino acid
  variant (42)..(42): Xaa can be any naturally occurring amino acid
  variant (49)..(49): Xaa can be any naturally occurring amino acid
  variant (51)..(51): Xaa can be any naturally occurring amino acid
  variant (65)..(65): Xaa can be any naturally occurring amino acid
  variant (114)..(114): Xaa can be any naturally occurring amino acid
  variant (131)..(131): Xaa can be any naturally occurring amino acid
  variant (176)..(176): Xaa can be any naturally occurring amino acid
  variant (194)..(194): Xaa can be any naturally occurring amino acid
  variant (198)..(198): Xaa can be any naturally occurring amino acid
  variant (203)..(203): Xaa can be any naturally occurring amino acid
  variant (302)..(302): Xaa can be any naturally occurring amino acid
  variant (320)..(320): Xaa can be any naturally occurring amino acid
  variant (359)..(359): Xaa can be any naturally occurring amino acid
  variant (409)..(409): Xaa can be any naturally occurring amino acid
  variant (441)..(441): Xaa can be any naturally occurring amino acid
  variant (448)..(448): Xaa can be any naturally occurring amino acid
MGARASVLSGGXLDTWEKIRLRPGSKKKYQLKHXVWASRELXRFAVNPXLXETSEGCRQIMRQLXPSLQTGSEELKSLYNTIAVLYCVHQRIEIRDTKEALDKIEEEKSKKKAXQQAAADTESSKQVSQNXPIVQNLQGQMVHQAISPRTLNAWVKVVEEKAFSPEVIPMFSALAXGATPGDLNTMLNTVGGHXAAMXMLKEXINEEAAEWDRLHPVQAGPVAPGQIREPRGSDIAGTTSTLQEQIAWMTNNPPIPVGDIYKRWIIIGLNKIVRMYSPTSILDIKQGPKEPFRDYVDRFYKXLRAEQASQEVKNWMTETXLVQNANPDCKSILKALGPGATLEEMMTACQGVGGPSHKXRVLAEAMSQANSAAIMMQKGNFRNQRKTVKCFNCGKEGHLARNCRAPRKXGCWKCGQEGHQMKDCTERQANFLGKFWPSHKXRPGNFLXSRPEQSRPEPSAPPEESFRFGEETTTPPQKQEPRDKELYPLASLKSLFGNDPSSQ

SEQ ID NO: 652 - protein, 500 aa, Human immunodeficiency virus
  variant (15)..(15): Xaa can be any naturally occurring amino acid
  variant (103)..(103): Xaa can be any naturally occurring amino acid
  variant (115)..(115): Xaa can be any naturally occurring amino acid
  variant (213)..(213): Xaa can be any naturally occurring amino acid
  variant (312)..(312): Xaa can be any naturally occurring amino acid
  variant (320)..(320): Xaa can be any naturally occurring amino acid
  variant (326)..(326): Xaa can be any naturally occurring amino acid
  variant (332)..(332): Xaa can be any naturally occurring amino acid
  variant (479)..(479): Xaa can be any naturally occurring amino acid
MGARASVLSGGELDXWEKIRLRPGGKKRYKLKHIVWASRELERFAVNPGLLETSEGCRQIIGQLQPSLQTGSEELKSLFNTVAVLYCVHQRIEIKDTKEALDXIEEEQNKSKKKXQQAAADTGDRGQVSQNYPIVQNLQGQMVHQAISPRTLNAWVKVVEEKAFSPEVIPMFSALSEGATPQDLNTMLNTVGGHQAAMQMLKETINEEAAEWXRLHPVHAGPIAPGQMREPRGSDIAGTTSTLQEQVAWMTNNPPIPVGEIYKRWIIIGLNKVVKMYSPISILDIRQGPKEPFRDYVDRFYKTLRAEQATQXVKNWMTEXLLVQNXNPDCKXILKALGPGATLEEMMSACQGVGGPSHKARILAEAMSQVAQPATIMMQKGNFRSQRKPVKCFNCGKEGHIAKNCRAPRKRGCWKCGREGHQMKECTERQANFLGKIWPSHKGRPGNFPQSRTEPSAPPEESFRFGEETTTPSQKKETXDKELYPLASLKSLFGNDPSSQ

SEQ ID NO: 653 - protein, 502 aa, Human immunodeficiency virus
  variant (143)..(143): Xaa can be any naturally occurring amino acid
  variant (395)..(395): Xaa can be any naturally occurring amino acid
  variant (444)..(444): Xaa can be any naturally occurring amino acid
  variant (460)..(460): Xaa can be any naturally occurring amino acid
  variant (489)..(489): Xaa can be any naturally occurring amino acid
  variant (501)..(501): Xaa can be any naturally occurring amino acid
MGARASVLSGGELDRWEKIRLRPGGKKKYQLKHIVWASREEERFAINPGLLETSAGCKQILIQLQPSLQNGSEELKSLYNTVATLYCVHQKIDVKDTKEALDKIEEEQNKSKKKAQQAAADTGNSSQVSQNYPIVQNMQGQMXHQALSPRTLNAWVKVIEEKAFSPEVIPMFTALSEGATPQDLNTMLNTVGGHQAAMQMLKETINEEAAEWDRLHPVHAGPVAPGQMREPRGSDIAGTTSNLQEQVAWMTSNPPIPVGEIYKRWIILGLNKIVRMYSPVSILDIKQGPKEPFRDYVDRFYKTLRAEQATQEVKNWMTETLLVQNSNPDCKTILKALGPAATLEEMMTACQGVGGPGHKARVLAEAMSQVTNSTNIMMQKGNFRNQRKTVKCFNXGKEGHIARNCRAPRKKGCWKCGREGHQMKDCTERQANFLGKVWPSHKGXPGNFLQSRPEPTAPPXESFKFVKETTTPPQEQNLIDLDKEVYPLXSLRSLFGNDPSXK

SEQ ID NO: 654 - protein, 495 aa, Human immunodeficiency virus
  variant (426)..(426): Xaa can be any naturally occurring amino acid
MGARASVLSGGELDKWEKIRLRPGGKKKYKLKHIVWASRELERFAVNPGLLETSEGCRQILGQLQPSLQTGSEELRSLFNTVAVLYCVHQKIEVKDTKEALEKIEEEQNKCKKKAQQAAAGTGNSNQASQNYPIVQNLQGQMVHQALSPRTLNAWVKVIEEKAFSPEVIPMFSALSEGATPQDLNTMLNTVGGHQAAMQMLKETINEEAAEWDRLHPPQAGPVAPGQMRDPRGSDIAGTTSTLQEQIGWMTSNPPIPVGEIYKRWIILGLNKIVRMYSPVSILDIRQGPKEPFRDYVDRFYKTLRAEQASQEVKNWMTETLLVQNANPDCKTILKALGPAATLEEMMTACQGVGGPGHKARVLAEAMSQVNSGAAMMQRGNFRNQRKTVKCFNCGKEGHIARNCKAPRKKGCWKCGREGHQMKDCXERQANFLGKIWPSHKGRPGNFLQSRPEPSAPPEESFRFVEETTTPSQKPEELYPLASLKSLFGNDPSSQ

SEQ ID NO: 655 - protein, 501 aa, Human immunodeficiency virus
MGARASVLSGGELDRWEKIRLRPGGRKQYKLKHIVWASRELERFAINPGLLESSGGCKQILAQLQPALKTGSEELKSLFNTVATLYCVHQRIDVKDTKEALDKIEEEQNKCQKKAQQAATDTGNSSSNQVSRNYPIVQNLQGQMVHQAISPRTLNAWVKVIEEKAFSPEVIPMFSALSEGATPQDLNTMLNTVGGHQAAMQMLKETINEEAAEWDRLHPAQAGPIAPGQIREPRGSDIAGTTSTLQEQITWMTNNPPIPVGEIYKRWIILGLNKIVRMYSPISILDIRQGPKEPFRDYVDRFYKTLRAEQATQEVKNWMTETLLVQNANPDCKTILKALGPAATLEEMMTACQGVGGPGHKARVLAEAMSQVNPNNVMMQRGNFRNQRKIVKCFNCGKEGHIARNCKAPRKKGCWKCGKEGHQMKDCAERQANFLGKIWPSHKGRPGNFPQSRPEPTAPPAECFGFGEETTTPSQKQEPTDKELYPLASLKSLFGNDPSSQ

SEQ ID NO: 656 - protein, 502 aa, Human immunodeficiency virus
  variant (394)..(394): Xaa can be any naturally occurring amino acid
  variant (437)..(437): Xaa can be any naturally occurring amino acid
MGARASVLSGGELDKWERIRLRPGGKKKYRLKHIVWASRELERFAVNPGLLETAGGCRQILGQLQPSLQTGSEELRSLFNTVAVLYCVHQKIEIKDTKEALDKIEEEQNKSKKKAQQATADTGNNNQVSQNYPIVQNLQGQMVHQPISPRTLNAWVKVVEEKAFSPEVIPMFSALSEGATPQDLNTMLNTVGGHQAAMQMLKETINEEAADWDRLHPVHAGPIAPGQMREPRGSDIAGTTSTLQEQIGWMTNNPPIPVGEIYKRWIILGLNKIVRMYSPSSILDIRQGPKEPFRDYVDRFYKTLRAEQASQEVKNWMTETLLVQNANPDCKTILKALGPAATLEEMMTACQGVGGPGHKARVLAEAMSQVNSATVMMQRGNFRNPRKTVKCFNXGKEGHIARNCRAPRKKGCWKCGKEGHQMRDCTERQANFLGKIXPSHKGRPGNFLQNRPEPTAPSAPPEESFRFGEGTTAPSQKQEPIDKELYPLASLRSLFGSDPSSQ

SEQ ID NO: 657 - protein, 508 aa, Human immunodeficiency virus
  variant (399)..(399): Xaa can be any naturally occurring amino acid
MGARASILSAGELDRWEKIRLRPGGKKKYRLKHLVWASRELERFAVNPGLLETSGGCRQILEQLQPSLQTGSEELKSIYNTVATLYCVHQKIDVKDTKEALDKIEEEQNKSKKKTQQAAAGTGNSSQVSQNYPIVQNLQGQMVHQAISPRTLNAWVKVVEEKAFSPEVIPMFSALSEGATPQDLNTMLNTVGGHQAAMQMLKDTINEEAAEWDRLHPVHAGPIAPGQMREPRGSDIAGTTSTLQEQIGWMTNNPPIPVGEIYKRWIIMGLNKIVRMYSPTSILDIKQGPKEPFRDYVDRFYKTLRAEQASQDVKNWMTETLLVQNANPDCKTILKALGPAATLEEMMTACQGVGGPSHKARVLAEAMSQVTNSASAAIMMQKGNFGNQRKTVKCCNCGXVGHIARNCRAPRKKGCWKCGKEGHQMKDCNERQANFLGKIWPSHKGRPGNFLQSRPEPTAPPEPTAPPEESFRFGEAAATPSQKQEPIDKDLYPLASLRSLFGNDQLSQ

SEQ ID NO: 658 - protein, 503 aa, Human immunodeficiency virus
  variant (411)..(411): Xaa can be any naturally occurring amino acid
  variant (465)..(465): Xaa can be any naturally occurring amino acid
MGARASVLSGGELDRWEKIRLRPGGKKKYKLKHIVWASRELERFAVNPGLLETSEGCRQILGQLQPSLQTGSEELKSLYNAVAVLYCVHQRIDVKDTKEALEKIEEEQNKSKKKAQQAAADTGTSSSSSQVSQNYPIVQNLQGQMVHQPLSPRTLNAWVKVVEEKAFSPEVIPMFSALSEGATPQDLNTMLNTVGGHQAAMQMLKETINEEAAEWDRLHPVHAGPIAPGQMREPRGSDIAGTTSNLQEQIGWMTHNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPSHKARVLAEAMSQATNSANIMMQRGNFGKQRKTVKCFNCGKEGHIAKNCRAXRKRGCWKCGKEGHQMKDCTERQANFLGKIWPSHKGRPGNFLQSRPEPTAPPEEXFRFGEETTTPSQKQETIDKELYPLASLRSLFGNDPSSQ

SEQ ID NO: 659 - protein, 505 aa, Human immunodeficiency virus
  variant (404)..(404): Xaa can be any naturally occurring amino acid
MGARASVLSGGELDKWEKIRLRPGGKKKYKLKHIVWASRELERFAVNPGLLETSEGCRQILGQLQPSLQTGSEELKSLYNTIATLYCVHQKIDVKDTKEALDKIEEEQNKSKKKAQQAAADTRNTADTKSSQVSQNYPIVQNIQGQMVHQAISPRTLNAWVKVVEEKAFSPEVIPMFSALSEGATPQDLNTMLNTVGGHQAAMQMLKETINEEAAEWDRVHPVQAGPVAPGQMREPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPSHKARILAEAMSQVTNSATIMMQRGNFRNQRKSVKCFNCGKRXHIARNCRAPRKKGCWKCGKEGHQMKDCTERQANFLGKIWPSHKGRPGNFLQSRPEPTAPPAECFRFGEETATPPQKQEPIEKELYPLTSLRSLFGNDPSSQ

SEQ ID NO: 660 - protein, 500 aa, Human immunodeficiency virus
MGARASVLSGGKLDRWEKIRLRPGGKKKYKLKHIVWASRELERFAVNPGLLETSEGCRQILRQLQPSLQTGSEELKSLYNTVATLYCVHQGIEVKDTKEALDKIEEEQNKCKKKAQQAAADTGNSSQSSQNYPIVQNLQGQMVHQALSPRTLNAWVKVVEEKAFSPEVIPMFTALSEGATPQDLNTMLNTVGGHQAAMQMLKETINEEAAEWDRVHPVHAGPVAPGQMREPRGSDIAGVTSTLQEQIGWMTSNPPIPVGEIYKKWIIMGLNKIVRMYSPTSILDIKQGPKEPFRDYVDRFYKTLRAEQASQEVKNWMTETLLVQNANPDCKTILKALGPAATLEEMMTACQGVGGPGHKARVLAEAMSQVTNSANVMMQRGNFRDQRKKVKCFNCGKEGHLAKNCRAPRKKGCWKCGKEGHQMKECTERQANFLGKIWPSHKGRPGNFLQSRPEPTAPPEESFRFGEETTTPPQKQEPIDKELYPSASLKSLFGNDPLLQ

SEQ ID NO: 661 - protein, 500 aa, Human immunodeficiency virus
  variant (188)..(188): Xaa can be any naturally occurring amino acid
  variant (201)..(201): Xaa can be any naturally occurring amino acid
  variant (215)..(215): Xaa can be any naturally occurring amino acid
  variant (295)..(295): Xaa can be any naturally occurring amino acid
  variant (498)..(498): Xaa can be any naturally occurring amino acid
MGARASVLSGGELDKWEKIRLRPGGKKKYKLKHIVWASRELERFAVNPGLLETSDGCRQILGQLQPSLQTGSEELKSLFNTVAVLYCVHQRIDVKDTKEALDKVEEEQNKSKKKAQQAAADTGNSSQVSQNYPIVRNIQGQMVHQPISPRTLNAWVKVIEEKAFSPEVIPMFSALSEGATPQDLNTMXNTVGGHQAAMQMXKETINEEAAEWDRXHPAQAGPVAPGQIREPRGSDIAGTTSTLQEQIDWMTHNPPIPVGEIYKRWIILGLNKIVRMYSPTSILDIKQGPKEPFRXYVDRFYKTLRAEQASQEVKNWMTETLLVQNANPDCKTILKALGPAATLEEMMTACQGVGGPGHKARVLAEAMSQMTNATNIMMQGGNFRNQRKFIKCFNCGKEGHLAKNCRAPRKRGCWKCGKEGHQMKDCTERQANFLGKIWPSHKGRPGNFLQNRPEPSAPPEEGCRYGEETTTPSQKQEPIDQEKYPLASLRSLFGSDPXSQ

SEQ ID NO: 662 - protein, 500 aa, Human immunodeficiency virus
MGARASVLSGGELDKWEKIRLRPGGKKKYKLKHLVWASRELERFAVNPGLLETAEGCRQILAQLQPALQTGSEELKSVYNTVATIYCVHQRIEVKDTKEALDKIEEEQNKSKKKTQQAAAGAGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPSHKARILAEAMSQVTSPTTIMMQRGNFKNPRRSVKCFNCGKEGHIAKNCRAPRKKGCWRCGKEGHQMKDCVEGQANFLGKIWPSHKGRPGNFLQSRPEPTAPPEESFRFGEETATPPQKQEPTDRELYPLASLRSLFGNDPSSQ

SEQ ID NO: 663 - protein, 502 aa, Human immunodeficiency virus
  variant (7)..(7): Xaa can be any naturally occurring amino acid
  variant (24)..(24): Xaa can be any naturally occurring amino acid
  variant (34)..(34): Xaa can be any naturally occurring amino acid
  variant (48)..(48): Xaa can be any naturally occurring amino acid
  variant (51)..(51): Xaa can be any naturally occurring amino acid
  variant (54)..(54): Xaa can be any naturally occurring amino acid
  variant (75)..(75): Xaa can be any naturally occurring amino acid
  variant (81)..(81): Xaa can be any naturally occurring amino acid
  variant (91)..(91): Xaa can be any naturally occurring amino acid
  variant (98)..(98): Xaa can be any naturally occurring amino acid
  variant (100)..(100): Xaa can be any naturally occurring amino acid
  variant (103)..(103): Xaa can be any naturally occurring amino acid
  variant (123)..(123): Xaa can be any naturally occurring amino acid
  variant (129)..(129): Xaa can be any naturally occurring amino acid
  variant (150)..(150): Xaa can be any naturally occurring amino acid
  variant (167)..(167): Xaa can be any naturally occurring amino acid
  variant (169)..(169): Xaa can be any naturally occurring amino acid
  variant (357)..(357): Xaa can be any naturally occurring amino acid
  variant (367)..(367): Xaa can be any naturally occurring amino acid
  variant (473)..(473): Xaa can be any naturally occurring amino acid
  variant (497)..(497): Xaa can be any naturally occurring amino acid
  variant (500)..(500): Xaa can be any naturally occurring amino acid
MGARASXLSGGELDRWEKIRLRPXGKKKYRLKHXVWASRELERFAVNXGLXETXEGCRQILGQLQPSLQTGSEEXKSLYNXIAVLYCVHQXIDVKDTXEXLDXIEEEQNKSKKKAQQAAAVHXDTGNSXQVSQNYPIVQNLQGQMVHQPXSPRTLNAWVKVVEEKAXSXEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIKQGPKEPFRDYVDRFYKVLRAEQASQDVKNWMTETLLVQNANPDCKTILKALGPAATLEEMMTACQGVXGPGHKARVLXEAMSQVTNSATIMMQRGNFRGPRKNVKCFNCGREGHIAKNCRAPRKKGCWKCGKEGHQMKDCTERQANFLGKIWPSHKGRPGNFLQSRPEPTAPPEESFRFGEETXPSQKPEPIDKDLYPLASLKSLFGXDPXSQ

SEQ ID NO: 664 - protein, 504 aa, Human immunodeficiency virus
  variant (92)..(92): Xaa can be any naturally occurring amino acid
  variant (314)..(314): Xaa can be any naturally occurring amino acid
  variant (410)..(410): Xaa can be any naturally occurring amino acid
  variant (436)..(436): Xaa can be any naturally occurring amino acid
  variant (453)..(453): Xaa can be any naturally occurring amino acid
  variant (467)..(467): Xaa can be any naturally occurring amino acid
  variant (469)..(469): Xaa can be any naturally occurring amino acid
  variant (471)..(471): Xaa can be any naturally occurring amino acid
  variant (478)..(478): Xaa can be any naturally occurring amino acid
  variant (481)..(481): Xaa can be any naturally occurring amino acid
  variant (485)..(485): Xaa can be any naturally occurring amino acid
MGARASVLSGGELDRWEKIRLRPGGKKKYKLKHVVWASRELERFAVNPGLLETSEGCRKILGQLQPSLQTGSEELKSLYNTVATLYCVHQKXDVRDTKEALEKIEEEQNKCKKKAQQAAADTGNNTGNSSQVSQNYPIVQNLQGQMVHQAISPRTLNAWVKVVEEKAFSPEVIPMFTALSEGATPQDLNTMLNTVGGHQAAMQMLKETINEEAAEWDRMHPVHAGPIAPGQMREPRGSDIAGTTSTLQEQIGWMTSNPAIPVGEIYKRWIILGLNKIVRMYSPTSILDIKQGPKEPFRDYVDRFYKTLRAEQAXQDVKNWMTETLLVQNANPDCKTILKALGPAATLEEMMTACQGVGGPGHKARVLAEAMSQVTNSASIMMQRGNFRNQRKTVKCFNCGKEGHIARNCXAPRKKGCWKCGREGHQMKDCTERQAXFLGKIWPSHKGRPGNFXQSRPEPTAPPAPPXEXFXFGEETTXPSXKQEXIDKELYPLASLKSLFGNDH

SEQ ID NO: 665 - protein, 500 aa, Human immunodeficiency virus
MGARASVLSGGELDRWEKIRLRPGGKKKYRLKHIVWASRELERFAVNPGLLETSVGCKQILEQLQPSLQTGSEELKSLFNTIATLYCVHLRIDVKDTKEALDKIEEEQNKSKKKAQQAAAGTGNNSQVSQNYPIVQNLQGQMVHQPLSPRTLNAWVKVVEEKAFSPEVIPMFSALSEGATPQDLNTMLNTVGGHQAAMQMLKETINEEAADWDRLHPVHAGPVAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTTPPVIMMQKDNFRNQKRTVKCFNCGRDGHIAKNCRAPRKRGCWKCGKEGHQMKDCTERQANFLGKIWPSYKGRPGNFLQSRPEPTAPPEESFRFGEETTTPSQKQEPIDKEMYPLTSLKSLFGNDPSSQ

SEQ ID NO: 666 - protein, 502 aa, Human immunodeficiency virus
  variant (467)..(467): Xaa can be any naturally occurring amino acid
MGARASVLSGGKLDRWEKIRLRPGGKKKYKLKHLVWASRELERFAVNPSLLETPEGCRQILGQLHPSLQTGSEELKSLYNTVATLYCVHQNIDVKDTKEALEKVEEEQNKSKKKAQQAAADTGSSSQVSQNYPIVQNLQGQMVHQALSPRTLNAWVKVVEEKAFSPEVIPMFTALSEGATPQDLNTMLNTVGGHQAAMQMLKETINEEAAEWDRLHPVHAGPIAPGQMREPRGSDIAGTTSNLQEQIGWMTNNPPIPVGEIYKRWIILGLNKIVRMYSPTSILDIKQGPKEPFRDYVDRFYKTLRAEQASQEVKNWMTETLLVQNSNPDCKTILKALGPAATLEEMMTACQGVGGPGHKARVLAEAMSQVTNSTAVMMQKGTFRNQRKPVKCFNCGKEGHIARNCRAPRKRGCWKCGKEGHQMKDCTERQANFLGRIWPSHKGRPGNFLQSRPEPTAPPEESFRFGXETTTPSQKQELIDLDKELYPLASLKSLFGNDPSSK

SEQ ID NO: 667 - protein, 505 aa, Human immunodeficiency virus
  variant (5)..(5): Xaa can be any naturally occurring amino acid
  variant (16)..(16): Xaa can be any naturally occurring amino acid
  variant (73)..(73): Xaa can be any naturally occurring amino acid
  variant (78)..(78): Xaa can be any naturally occurring amino acid
  variant (120)..(120): Xaa can be any naturally occurring amino acid
  variant (220)..(220): Xaa can be any naturally occurring amino acid
  variant (478)..(478): Xaa can be any naturally occurring amino acid
MGARXSVLSGGELDRXKKIRLRPGGKKKYKLKHIVWASRELERFAVNPGLLETSGGCKQILQQLQPSLQTGSXELKSXYNTVATLYCVHNKIEVRDTKEALEKIEEEQNKSKKRAQQAAXDTGNNSQVSQNYPIVQNMQGQMVHQALSPRTLNAWVKVVEEKAFSPEVIPMFAALSEGATPQDLNTMLNTVGGHQAAMQMLKETINEEAAEWDRLHPVHXGPIAPGQMREPRGSDIAGTTSTLQEQIGWMTHNPPIPVGEIYKKWIIMGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTGSATIMMQGGNYKNQRKTVKCFNCGKEGHIAKNCRAPRKRGCWKCGKEGHQMKECTERQANFLGKIWPSHKGRPGNFLQSKSETTRIEPTAPPAESFRFGEETTTPXQKPELIDKEMYPLASLRSLFGNDPSSQ

SEQ ID NO: 668 - protein, 502 aa, Human immunodeficiency virus
  variant (297)..(297): Xaa can be any naturally occurring amino acid
  variant (442)..(442): Xaa can be any naturally occurring amino acid
  variant (446)..(446): Xaa can be any naturally occurring amino acid
  variant (448)..(448): Xaa can be any naturally occurring amino acid
  variant (451)..(451): Xaa can be any naturally occurring amino acid
  variant (482)..(482): Xaa can be any naturally occurring amino acid
  variant (488)..(488): Xaa can be any naturally occurring amino acid
MGARASVLSGGKLDRWERIRLRPGGKKKYKLKHLVWASRELERFAVNPGLLETAEGCRQILGQLQPSLQTGSEELKSLFNTVATLYCVHQGIDVKDTKEALDKIEEEQNKSKKKAQQAAAQTAAADTGSNNQVSHNYPIVQNIQGQMVHQAISPRTLNAWVKVIEEKAFSPEVIPMFTALSEGATPQDLNTMLNTVGGHQAAMQMLKETINEEAAEWDRLHPVHAGPVAPGQMREPRGSDIAGTTSTLQEQIAWMTNNPPVPVGEIYKRWIILGLNKIVRMYSPVSILDIKQGPKEXFRDYVDRFYKTLRAEQASQDVKNWMTETLLVQNANPDCKTILKALGPGATLEDMMTACQGVGGPGHKARVLAEAMSQMNSTTVMMQRGNFRNQRKIVKCFNCGKEGHIAKNCRAPRKKGCWKCGQEGHQMKDCTERQANFLGKIXPSHXGXPGXFLQSRPEPTAPPEESFRFGEETTTPPQKQEXKELYPXTSLRSLFGNDPLSQ

SEQ ID NO: 669 - protein, 502 aa, Human immunodeficiency virus
MGARASVLSGGELDRWEKIRLRPGGKKKYRLKHIIWASRELERFSVNPGLLETSEGCRQILGQFQPSLQTGSEELKSLYNTVATLYCVHQRIDVKDTKEALEKVEEEQNKSKKKAQQAAADTGNSNKVSQNYPIVQNMQGQMVHQPISPRTLNAWVKVIEEKAFSPEVIPMFSALSEGATPQDLNTMLNTVGGHQAAMQMLKEAINEEAAEWDRLHPVAAGPVAPGQMREPRGSDIAGTTSTLQEQIGWMTSNPPIPVGEIYKRWIIMGLNKIVRMYSPVSILDIRQGPKEPFRDYVDRFYKTLRAEQATQEVKNWMTETLLVQNANPDCKTILKALGPAASLEEMMTACQGVGGPGHKARVLAEAMSQVTNSSAIMMQRGNFRDQRKIVKCFNCGKDGHIAKNCRAPRKRGCWKCGKEGHQMKDCTERERQANFLGKIWPSHKGRPGNFHQSRLEPTAPPEESFRFGEETTTPSQRQEPKDKELYPLASLKSLFGNDPSSQ

SEQ ID NO: 670 - protein, 498 aa, Human immunodeficiency virus
  variant (497)..(497): Xaa can be any naturally occurring amino acid
MGARASVLSGGELDRWERIRLRPGGSKKYKLKHIVWASRELERFAVNPSLLETSEGCKQILGQLQPSLQTGSEELKSLFNTVATLYCVHQRIEIKDTQEALEKIKEEQDKSKKRAQQAEAGTGNSSQASQNYPIVQNLQGQMVHQPLTPRTLNAWVKVIEEKAFSPEVIPMFSALSEGATPQDLNTMLNTVGGHQAAMQMLKETINEEAAEWDRMHPVHAGPIAPGQMREPRGSDIAGTTSTLQEQIGWMTSNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVNSTNIMMQKGNVRNQRKTVKCFNCGKEGHIARNCRAPRKKGCWKCGREGHQMKDCTERQANFLGKIWPSSKGRPGNFPQSRTEPTAPPEESFRFGEQTTPHQKQEPIDQERSPLTSLRSLFGNDPLXQ

SEQ ID NO: 671 - protein, 503 aa, Human immunodeficiency virus
  variant (128)..(128): Xaa can be any naturally occurring amino acid
  variant (159)..(159): Xaa can be any naturally occurring amino acid
  variant (219)..(219): Xaa can be any naturally occurring amino acid
  variant (372)..(372): Xaa can be any naturally occurring amino acid
  variant (400)..(400): Xaa can be any naturally occurring amino acid
  variant (481)..(481): Xaa can be any naturally occurring amino acid
  variant (502)..(502): Xaa can be any naturally occurring amino acid
MGARASILSGGELDRWEKIRLRPGGKKQYRLKHLVWASRELERFAVNPGLLETSDGCRRILKQLQPSLQTGSEELKSLYNTVATLYCVHQRIGVRDTKEALDKVEEEQNESKKKTQQAAAGTGNNSQXSQNYPIVQNLQGQMVHQALSPRTLNAWVKVXEEKAFSPEVIPMFSALSEGATPQDLNTMLNTVGGHQAAMQMLKETINEEAAEWDRLHPVXAGPVAPGQMREPRGSDIAGTTSTLQEQIGWMTNNPPIPVGEIYKRWIIMGLNKIVRMYSPTSILDIRQGPKEPFRDYVDRFYKTLRAEQASQEVKNWMTETLLVQNANPDCKTILKALGPGATLEEMMTACQGVGGPGHKARVLAEAMSQVTXSATIMMQRGNFKNQRKTVKCFNCGKEGXIARNCRAPRKKGCWKCGQEGHQMKDCTERQANFLGKIWPSHKGRPGNFLQSRPEPTAPPAPPEESFRFGEKTTTPPQKQEXLDKELYPVTSLRSLFGNDPSXQ

SEQ ID NO: 672 - protein, 500 aa, Human immunodeficiency virus
MGARASVLSGGKLDNWEKIRLRPGGKKKYRLKHIVWASRELERFAVNPGLIETAEGCKQILGQLQPSLQTGSEELKSLFNTIAVLYCVHKRIEVRDTKEALDKIEEEQNNSKKKAQQAEADTGNSKQVSQNYPIVQNLQGQMVHQAISPRTLNAWVKVVEEKAFSPEVIPMFSALSEGATPQDLNTMLNTVGGHQAAMQMLKETINEEAAEWDRLHPAQAGPIAPGQMREPRGSDIAGTTSTLQEQIGWMTSNPPVPVGEIYKRWIIMGLNKIVRMYSPTSILDIKQGPKEPFRDYVDRFYKTLRAEQASQEVKHWMTETLLVQNANPDCKTILKALGPGATLEEMMSACQGVGGPGHKARVLAEAMSQVTNSAAIMMQKGNFRSQRKPIKCFNCGKEGHTARNCRAPRKKGCWKCGKEGHQMKECTERQANFLGKIWPSHKGRPGNFLQSRPEPTAPPEESFRFGEETTAPAQKQEPIVKEMYPLTSLRSLFGNDPSSQ

SEQ ID NO: 673 - protein, 507 aa, Human immunodeficiency virus
  variant (82)..(82): Xaa can be any naturally occurring amino acid
  variant (360)..(360): Xaa can be any naturally occurring amino acid
  variant (380)..(380): Xaa can be any naturally occurring amino acid
  variant (397)..(397): Xaa can be any naturally occurring amino acid
  variant (399)..(399): Xaa can be any naturally occurring amino acid
MGARASVLSGGELDKWEKIRLRPGGKKKYKLKHIVWASRELERFAVNPGLLETSGGCRQILEQLQPSLQTGSEELRSLYNTXATLYCVHQKIEIKDTKEALEKIEEEQNKSKKKTQQAAAAAAAAAADTGNRGQVSQNYPIVQNLQGQMVHQPISPRTLNAWVKVIEEKAFSPEVIPMFTALSEGATPQDLNTMLNTVGGHQAAMQMLKETINEEAAEWDRLHPVHAGPIAPGQMREPRGSDIAGTTSTLQEQIGWMTNNPAIPVGEIYKRWIILGLNKIVRMYSPTSILDIKQGPKEPFRDYVDRFYKTLRAEQASQEVKNWMTETLLVQNSNPDCKTILKALGPAATLEEMMTACQGXGGPSHKARVLAEAMSQATNXATVMMQRGNFRNQRKTXKXFNCGKEGHIAKNCRAPRKRGCWKCGKEGHQMKDCTERQANFLGKIWPSHKGRPGNFLQSRPEPSAPPEESFRFGEEATAPPQKQEPTDKDLYPLASLRSLFGNDPSSQ

SEQ ID NO: 674 - protein, 499 aa, Human immunodeficiency virus
  variant (84)..(84): Xaa can be any naturally occurring amino acid
  variant (86)..(86): Xaa can be any naturally occurring amino acid
  variant (181)..(181): Xaa can be any naturally occurring amino acid
  variant (208)..(208): Xaa can be any naturally occurring amino acid
  variant (226)..(226): Xaa can be any naturally occurring amino acid
  variant (253)..(253): Xaa can be any naturally occurring amino acid
  variant (389)..(389): Xaa can be any naturally occurring amino acid
  variant (447)..(447): Xaa can be any naturally occurring amino acid
MGARASILSGGELDRWEKIRLRPGGKKQYKLKHLVWASRELERFAVNPGLLETADGCKKILGQLHPSLQTGSEELKSLYNTVAXLXCVHQRIEVKDTKEALDKIEEEQNKCQKKAQQTAAGTGSGSQVSQNYPIVQNLQGQMVHQALSPRTLNAWVKVIEEKAFSPEVIPMFSALSEGATXQDLNTMLNTVGGHQAAMQMLKETINEXAAEWDRLHPVHAGPVAPXQMRDPRGSDIAGTTSTLQEQIAWMTGXPAIPVGEIYKRWIILGLNKIVRMYSPVSILDIKQGPKEPFRDYVDRFYKTLRAEQATQEVKNWMTETLLVQNANPDCKTILKALGPGATLEEMMTACQGVGGPGHKARVLAEAMSQMNSANVMMQQGNFKGQRRIXKCFNCGKEGHIAKNCRAPRKKGCWKCGKEGHQMKDCTNGRQANFLGKVWPSSKGRPGXFPQSRIEPSAPPEESLRFGEEMTPPQKQGQTDKELYPLTSLRSLFGSDPSSQ

SEQ ID NO: 675 - protein, 500 aa, Human immunodeficiency virus
  variant (34)..(34): Xaa can be any naturally occurring amino acid
  variant (40)..(40): Xaa can be any naturally occurring amino acid
  variant (66)..(66): Xaa can be any naturally occurring amino acid
  variant (93)..(93): Xaa can be any naturally occurring amino acid
  variant (122)..(122): Xaa can be any naturally occurring amino acid
  variant (139)..(139): Xaa can be any naturally occurring amino acid
  variant (269)..(269): Xaa can be any naturally occurring amino acid
  variant (304)..(304): Xaa can be any naturally occurring amino acid
  variant (341)..(341): Xaa can be any naturally occurring amino acid
  variant (465)..(465): Xaa can be any naturally occurring amino acid
  variant (471)..(471): Xaa can be any naturally occurring amino acid
MGARASVLSGGELDRWEKIRLRPGGKKKYKLKHXVWASRXLERFAVNPGLLETSEGCRQILGQLQXALQTGSEELKSLYNTVATLYCVHQRIXVKDTKEALEKIEEEQNKSKKKAQQAAADXGNSSQVSQNYPIVQNMXGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILXLNKIVRMYSPVSILDIRQGPKEPFRDYVDRFYKTXRAEQATQEVKNWMTETLLVQNANPDCKTILKALGPAXTLEEMMTACQGVGGPGHKARVLAEAMSQVTSSATVMMQKGNFRNQRKPVKCFNCGKDGHIARNCRAPRKRGCWKCGKEGHQMKDCTERQANFLGKIWPSSKGRPGNFLQNRPEPTAPPEESFRXGEETTXPSQKQETIDKDLYPLTSLKSLFGNDPSST

SEQ ID NO: 676 - protein, 503 aa, Human immunodeficiency virus
  variant (2)..(2): Xaa can be any naturally occurring amino acid
  variant (413)..(413): Xaa can be any naturally occurring amino acid
  variant (415)..(415): Xaa can be any naturally occurring amino acid
  variant (464)..(464): Xaa can be any naturally occurring amino acid
  variant (477)..(477): Xaa can be any naturally occurring amino acid
  variant (479)..(479): Xaa can be any naturally occurring amino acid
  variant (483)..(483): Xaa can be any naturally occurring amino acid
MXARASVLSGGKLDAWERIRLRPGGKKKYKLKHIVWASRELERFAVNPGLLETADGCRQILMQLQPSLQTGSEELKSLYNTVVTLYCVHQRIEVRDTKEALDKVEEEQNKSKKKAQQAAAATGESSRENSQVSHNYPIVQNLQGQMVHQALSPRTLNAWVKVVEEKAFSPEVIPMFTALSEGATPQDLNTMLNTVGGHQAAMQILKETINEEAADWDRVHPVHAGPIAPGQMREPRGSDIAGTTSTLQEQIGWMTSNPPIPVGEIYKRWIILGLNKIVRMYSPTSILDIKQGPKEPFRDYVDRFYKTLRAEQASQDVKNWMTETLLVQNANPDCKTILKALGPAATLEEMMTACQGVGGPSHKARVLAEAMSQVTNSATVMMQKGNFRNQKKIVKCFNCGKVGHIARNCRAPXKXGCWKCGKEGHQMKDCNEGQANFLGKIWPSHKGRPGNFPQSRLEPTAPPXESFRFGEETTPPXKXEPTXKELYPLASLRSLFGNDPSSQ

SEQ ID NO: 677 - protein, 501 aa, Human immunodeficiency virus
  variant (101)..(101): Xaa can be any naturally occurring amino acid
  variant (210)..(210): Xaa can be any naturally occurring amino acid
  variant (222)..(222): Xaa can be any naturally occurring amino acid
  variant (243)..(243): Xaa can be any naturally occurring amino acid
  variant (269)..(269): Xaa can be any naturally occurring amino acid
  variant (304)..(304): Xaa can be any naturally occurring amino acid
  variant (323)..(323): Xaa can be any naturally occurring amino acid
  variant (338)..(338): Xaa can be any naturally occurring amino acid
  variant (429)..(429): Xaa can be any naturally occurring amino acid
  variant (442)..(442): Xaa can be any naturally occurring amino acid
  variant (484)..(484): Xaa can be any naturally occurring amino acid
MGARASVLSGGKLDKWEKIRLRPGGKKKYKLKHIIWASRELERFAVNPGLLETAEGCKRILIQLHPSLQTGSEELKSLYNTVATLYCVHQQIEIKDTKEAXDKIEEEQNKSKKKQEQQAAADTGNSSQVSHNYPIVQNLQGQMVHQALSPRTLNAWVKVVEEKAFSPEVIPMFSALSEGATPQDLNTMLNTVGGHQAAMQMLKETINEEXAEWDRLHPVHAXPIAPGQMREPRGSDIAGTTSXLQEQIAWMTNNPPIPVGEIYKRWIIXGLNKIVRMYSPTSILDIRQGPKEPFRDYVDRFYKXLRAEQASQEVKNWMTETLXVQNANPDCKTILKAXGPGATLEEMMTACQGVGGPSHKARVLAEAMSQVTSSATVMMQRGNGRNQRKTVKCFNCGREGHIAKNCRAPRKKGCWKCGKEGHQMKDCTXRQANFLGKIWPSXKGRPGNFLQSRPEPSAPPEESFRFGEETTTPAQKQEPIDKEXYPLTSLRSLFGNDPSSQ

SEQ ID NO: 678 - protein, 504 aa, Human immunodeficiency virus
  variant (4)..(4): Xaa can be any naturally occurring amino acid
MGAXASVLSGGELDKWEKIRLRPGGKKKYQLKHIVWASRELERFALNPGLLETSGGCRQILGQLQPSLQTGSEELRSLYNTVAVLYCVHQKIEIKDTKEALDKIEEEQNKSKKKAQQAAADTGNSSSQVSQNYPIVQNIQGQMVHQPLSPRTLNAWVKVIEEKNFSPEVIPMFSALAEGATPQDLNTMLNTVGGHQAAMQMLKETINEEAAEWDRLHPVQAGPVAPGQLREPRGSDIAGTTSTLQEQIAWMTHNPPIPVGEIYKRWIILGLNKIVRMYSPVSILDIRQGPKEPFRDYVDRFYKTLRAEQASQDVKNWMTETLLVQNANPDCKTILKALGPAATLEEMMTACQGVGGPSHKARVLAEAMSQVTNPATVMVQKGNFRNQRKIVKCFNCGKEGHIARNCRAPRKKGCWKCGQEGHQMKDCSERQANFLGKIWPSHKGRPGNFLQSRPEPSAPPEESFRFGEGTTTHPQKQEKQEPIDKELYPLASLRSLFGNDPSSQ

SEQ ID NO: 679 - protein, 500 aa, Human immunodeficiency virus
  variant (119)..(119): Xaa can be any naturally occurring amino acid
  variant (138)..(138): Xaa can be any naturally occurring amino acid
  variant (354)..(354): Xaa can be any naturally occurring amino acid
  variant (486)..(486): Xaa can be any naturally occurring amino acid
MGARASVLSGGDLDRWEKIRLRPGGKKQYKLKHIVWASRELERFAVNPGLLETAGGCKQILEQLQPALRTGSEELTSLYNTVAVLFCVHQKIEVKDTKEALEKIEEEQNKSKKKAQQAXADAGNKSQVSQNYPIVQNXQGQMVHQPIAPRTLNAWVKVVEEKAFSPEVIPMFSALSEGATPQDLNTMLNTVGGHQAAMQMLKETINEEAAEWDRLHPVQAGPIAPGQIREPRGSDIAGTTSTLQEQIAWMTHNPPIPVGDIYKRWIILGLNKIVRMYSPTSILDIRQGPKEPFRDYVDRFYKTLRAEQASQDVKNWMTETLLVQNANPDCKTILKALGPAATLEEMMTACQGVXGPGHKARVLAEAMSQVTNPATVMMQRGNFRNQRKIVKCFNCGKEGHIARNCRAPRKKGCWKCGKEGHQMKECTERQANFLGKIWPSHKGRPGNFLQSRPEPTAPPEESFRFGEEITTPSQKQEPIDKEQYPXTSLRSLFGNDPSSQ

SEQ ID NO: 680 - protein, 500 aa, Human immunodeficiency virus
  variant (93)..(93): Xaa can be any naturally occurring amino acid
  variant (188)..(188): Xaa can be any naturally occurring amino acid
  variant (286)..(286): Xaa can be any naturally occurring amino acid
  variant (310)..(310): Xaa can be any naturally occurring amino acid
  variant (334)..(334): Xaa can be any naturally occurring amino acid
  variant (359)..(359): Xaa can be any naturally occurring amino acid
  variant (406)..(406): Xaa can be any naturally occurring amino acid
  variant (442)..(442): Xaa can be any naturally occurring amino acid
  variant (444)..(444): Xaa can be any naturally occurring amino acid
  variant (460)..(460): Xaa can be any naturally occurring amino acid
  variant (471)..(471): Xaa can be any naturally occurring amino acid
MGARASVLSGGDLDRWEKIRLRPGGKKKYRLKHLVWASRELERFAVNPGLLETSEGCRQILGQLQPSLQTGSEELRSLYNTVATLYCVHQKIXVKDTKEALDKIEEEQNKSKKKAQQAAADTGNSNQVSRNYPIVQNMQGQNVHQALSPRTLNAWVKVIEEKAFSPEVIPMFTALSEGATPQDLNTMXNTVGGHQAAMQILKETINEEAAEWDRLHPVHAGPIAPGQMREPRGSDIAGTTSTLQEQIGWMTNNPPIPVGEIYKRWIVMGLNKIVRMYSPTSILDIXQGPKEPFRDYVDRFYKTLRAEQAXQEVKNWMTETLLVQNANPDCKHIXKALGPAATLEEMMTACQGVGGPAHXARVLAEAMSQVTNSATIMMQRGNLRNQRKIVKCFNCGKEGHIARNCXAPRKRGCWKCGKEGHQMKECTERQANFLGKIWPSPXGXPGNFLQSRPEPTAPPXESFRFGEEPTXPPQELGQKDKELYPLASLRSLFGNDPSSQ

SEQ ID NO: 681 - protein, 505 aa, Human immunodeficiency virus
  variant (62)..(62): Xaa can be any naturally occurring amino acid
  variant (82)..(82): Xaa can be any naturally occurring amino acid
  variant (125)..(125): Xaa can be any naturally occurring amino acid
  variant (138)..(138): Xaa can be any naturally occurring amino acid
MGARASVLSAGELDRWEKIRLRPGGKKKYRLKHIVWASRELERFAVNPGLLETAEGCRQILXQLQPSLQTGSEELKSLFNTXATLYCVHQKIEIRDTKEALDKIEEEQNKSKKQAQQAAAGTGNXSQASQNYPIVQNXQGQMVHQPISPRTLNAWVKVVEEKAFSPEVIPMFSALAEGATPQDLNTMLNTVGGHQAAMQMLKETINEEAAEWDRVHPVHAGPVAPGQMREPRGSDIAGTTSTLQEQIGWMTNNPPIPVGEIYKRWIILGLNKIVRMYSPTSILDIKQGPKEPFRDYVDRFYKTLRAEQASQEVKNWMTETLLVQNSNPDCKTILKALGPAATLEEMMTACQGVGGPGHKARVLAEAMSQVTNSATIMMQKGNFRNQRKAIKCFNCGKEGHVARNCRAPRKKGCWKCGREGHQMKDCTERQANFLGKIWPSHKGRPGNFLQSRPTAPPVEPTAPPEESFRFGEETTTPPQKQELTDKELYPLASLKSLFGNDPLSQ

SEQ ID NO: 682 - protein, 500 aa, Human immunodeficiency virus
  variant (56)..(56): Xaa can be any naturally occurring amino acid
  variant (146)..(146): Xaa can be any naturally occurring amino acid
  variant (166)..(166): Xaa can be any naturally occurring amino acid
  variant (168)..(168): Xaa can be any naturally occurring amino acid
  variant (260)..(260): Xaa can be any naturally occurring amino acid
  variant (283)..(283): Xaa can be any naturally occurring amino acid
  variant (327)..(327): Xaa can be any naturally occurring amino acid
  variant (353)..(353): Xaa can be any naturally occurring amino acid
  variant (390)..(390): Xaa can be any naturally occurring amino acid
  variant (428)..(428): Xaa can be any naturally occurring amino acid
MGARASILSGGELDRWEKIRLRPGGKKQYKLKHIVWASRELERFALNPGLLETTEXCRQILGQLQPSLQTGSEELKSLYNTVATLYCVHKKIDVRDTKEALDKIEEEQNKCKAKAQQAAAGTGNSSQVSQNYPIVQNLQGQMVHQXISPRTLNAWVKVVEEKAFSXEXIPMFSALSEGATPQDLNTMLNTVGGHQAAMQMLKETINEEAAEWDRLHPVHAGPIAPGQMREPRGSDIAGTTSTLQEQIGWMTNNPPIPVGXIYKRWIILGLNKIVRMYSPTSIXDIKQGPKEPFRDYVDRFYKTLRAEQATQEVKNWMTETLLVQNAXPDCKTILKALGPAATLEEMMTACQGXGGPGHKARVLAEAMSQVTNTSNAIMMQRGNFRNTKKXVKCFNCGKEGHIARNCRAPRKKGCWKCGKEGHQMKDCXRQANFLGKIWPSHKGRPGNFLQNRPEPTAPPEESFRFREETTTPSQKQEQIDKELYPLASLKSLFGNDPSSQ

SEQ ID NO: 683 - protein, 504 aa, Human immunodeficiency virus
  variant (9)..(9): Xaa can be any naturally occurring amino acid
  variant (26)..(26): Xaa can be any naturally occurring amino acid
  variant (29)..(29): Xaa can be any naturally occurring amino acid
  variant (73)..(73): Xaa can be any naturally occurring amino acid
  variant (91)..(91): Xaa can be any naturally occurring amino acid
  variant (185)..(185): Xaa can be any naturally occurring amino acid
  variant (215)..(215): Xaa can be any naturally occurring amino acid
  variant (217)..(217): Xaa can be any naturally occurring amino acid
  variant (219)..(219): Xaa can be any naturally occurring amino acid
  variant (223)..(223): Xaa can be any naturally occurring amino acid
  variant (230)..(230): Xaa can be any naturally occurring amino acid
  variant (389)..(389): Xaa can be any naturally occurring amino acid
  variant (407)..(407): Xaa can be any naturally occurring amino acid
  variant (413)..(413): Xaa can be any naturally occurring amino acid
  variant (435)..(435): Xaa can be any naturally occurring amino acid
  variant (451)..(451): Xaa can be any naturally occurring amino acid
  variant (453)..(453): Xaa can be any naturally occurring amino acid
  variant (477)..(477): Xaa can be any naturally occurring amino acid
  variant (489)..(489): Xaa can be any naturally occurring amino acid
MGARASVLXGGKLDRWERIRLRPGGXKKXKLKHLVWASRELERFAVNPGLLETSEGCRQILGQLQPALQTGSXELKSLYNTVATLYCVHQXIEVRDTKEALDKVEEEQNKSKKKAQQAAADTGNSNQVSQNYPIVQNLQGQMVHQAISPRTLNAWVKVVEEKAFSPEVIPMFSALSEGATPGDLXTMLNSVGGHQAAMQMLKETINEEAAEWDRXHXVXAGPXAPGQMRXPRGSDIAGTTSTLQEQIGWMTSNPPIPVGEIYKRWIILGLNKIVRMYSPTSILDIRQGPKEPFRDYVDRFYKTLRAEQASQEVKNWMTETLLVQNANPDCKTILKALGPGATLEEMMTACQGVGGPSHKARVLAEAMSQVTTSNAIMMQRGNFRNQGKXIKCFNCGKEGHLARNCKXPRKKGXWKCGREGHQMKDCTERQANFLXKIWPSHKGRPGNFLQXRXEPTAPPAEPTAPPAESFRFGEETXTPPQKQESMDKXMYPLASLRSLFGNDP

SEQ ID NO: 684 - protein, 500 aa, Human immunodeficiency virus
  variant (278)..(278): Xaa can be any naturally occurring amino acid
  variant (446)..(446): Xaa can be any naturally occurring amino acid
  variant (471)..(471): Xaa can be any naturally occurring amino acid
MGARASVLSGGELDRWEKIRLRPGGKKKYRLKHVVWASRELERFAVNPGLLETSEGCRQILGQLQPALQTGSEELRSLYNTVATLYCVHKKIDVKDTKEALDKIEEEQNKSKRKTQQAAADTGNSSQVSQNYPIVQNLQGQMVHQALSPRTLNAWVKVVEEKAFSPEVIPMFSALSEGATPQDLNTMLNTVGGHQAAMQMLKETINEEAAEWDRLHPVQAGPVAPGQIREPRGSDIAGTTSTLQEQIAWMTHNPPIPVGEIYKRWIILGLNKIVRMYXPTSILDIKQGPKEPFRDYVDRFYRTLRAEQASQEVKNWMTETLLVQNANPDCKTILKALGPAATLEEMMTACQGVGGPGHKARVLAEAMSQVTNSATIMMQKGNYRNQRKIVKCFNCGKEGHIAKNCKAPRKKGCWKCGKEGHQMKDCLERQANFLGKIWPSQKGRPXNFPQGRLEPTAPPEESFRSGEETTXPDQKQERTDKEMYPVTSLRSLFGNDPLSQ

SEQ ID NO: 685 - protein, 507 aa, Human immunodeficiency virus
  variant (431)..(431): Xaa can be any naturally occurring amino acid
MGARASVLSGGKLDKWEKIRLRPGGKKKYQLKHIVWASRELERFAVNPGLLETSDGCRQILGQFQPSLQTGSEELKSLYNTVATLYCVHQNIEVLDTKEALEKVEEEQNKSKKKAQQAAADTGNSKQVSQNYPIVQNLQGQMVHQAISPRTLNAWVKVIEEKAFSPEVIPMFSALSEGATPQDLNTMLNTVGGHQAAMQMLKETINEEAAEWDRLHPVPAGPVAPGQMRDPRGSDIAGTTSTLQEQIAWMTSNPPVPVGEIYKRWIILGLNKIVRMYSPVSILDIRQGPKEPFRDYVDRFYKTLRAEQASLEVKNWMTETLLVQNANPDCKTILKALGPGANLEEMMTACQGVGGPGHKARVLAEAMSQVTGSATIMMQKGNFGNQRRIVKCFNCGKDGHIAKNCRAPRKKGCWKCGKEGHQMKDCDGRQXNFLGKIWPSHKGRPGNFLQNRPEPTAPPEPTAPPAESFQFGEEMNPPQKQEGTDKGQGYPPLASLKSLFGSDPLLQ

SEQ ID NO: 686 - protein, 503 aa, Human immunodeficiency virus
  variant (435)..(435): Xaa can be any naturally occurring amino acid
  variant (470)..(470): Xaa can be any naturally occurring amino acid
MGARASVLSAGDLDKWEKIRLRPGGKKKYRLKHIVWASRELERFAVNPGLLETSGGCRQILGQLQPSLQTGSEELKSLYNTIAVLYCVHQKIEVKDTKEALDKIEEEQNKSKQKTQQAAAATGSSSQVSQNYPIVQNMQGAMVHQPMSPRTLNAWVKVIEEKAFSPEVIPMFVALSEGATPQDLNTMLNTVGGHQAAMQMLKETINEEAAEWDRTHPVHAGPVAPGQMREPRGSDIAGTTSTLQEQIAWMTSNPPVQVGEIYKRWIVLGLNKIVRMYSPTSILDIKQGPKEPFRDYVDRFYKTLRAEQATQEVKNWMTETLLVQNANPDCKTILKALGPAATLEEMMTACQGVGGPGHKARVLAEAMSQVTNSTAIMMQRGNFRNQRKTVKCFNCGKEGHLARNCRAPRKKGCWKCGKEGHQMKDCTERQANFLXKIWPSYKGRPGNFLQSRPEPTAPPAPPEESFRFGXETTTPPQKQEPIDKDLYPLASLRSLFGNDPSSQ

SEQ ID NO: 687 - protein, 510 aa, Human immunodeficiency virus
  variant (25)..(25): Xaa can be any naturally occurring amino acid
  variant (56)..(56): Xaa can be any naturally occurring amino acid
  variant (61)..(61): Xaa can be any naturally occurring amino acid
  variant (88)..(88): Xaa can be any naturally occurring amino acid
  variant (328)..(328): Xaa can be any naturally occurring amino acid
MGARASVLSGGELDKWEKIRLRPGXKKKYKLKHIVWASRELERFAVNPGLLETAGXCRQIXEQLQPSLQTGSEELKSLYNTVATLYCXHQKIEVKDTKEALDKVEEERNKSKKKAQQAAADTGSNSNQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPVAPGQMREPRGSDIAGTTSTLQEQIAWMTSNPPIPVGEIYKRWIILGLNKIVRMYSPTSILDIKQGPKEPFRDYVDRFYRTLRAEQASQDVKNWMTETLLVQNAXPDCKTILKALGPAASLEEMMTACQGVGGPGHKARVLAEAMSQVTNSATIMMQKGNFRSQGKTVKCFNCGKEGHIARNCRAPRKKGCWKCGREGHQMKDCTERQANFLGKIWPSHKGRPGNFLQNRPEPTAPQSRTEPTAPPEESFRFGEETTTPHQKQEPIDKELYPLASLKSLFGNDPLSQ

SEQ ID NO: 688 - protein, 502 aa, Human immunodeficiency virus
  variant (165)..(165): Xaa can be any naturally occurring amino acid
  variant (179)..(179): Xaa can be any naturally occurring amino acid
  variant (181)..(181): Xaa can be any naturally occurring amino acid
  variant (190)..(190): Xaa can be any naturally occurring amino acid
  variant (201)..(201): Xaa can be any naturally occurring amino acid
  variant (231)..(231): Xaa can be any naturally occurring amino acid
  variant (242)..(242): Xaa can be any naturally occurring amino acid
  variant (245)..(245): Xaa can be any naturally occurring amino acid
  variant (247)..(247): Xaa can be any naturally occurring amino acid
  variant (279)..(279): Xaa can be any naturally occurring amino acid
  variant (309)..(309): Xaa can be any naturally occurring amino acid
  variant (313)..(313): Xaa can be any naturally occurring amino acid
  variant (331)..(331): Xaa can be any naturally occurring amino acid
  variant (362)..(362): Xaa can be any naturally occurring amino acid
  variant (378)..(378): Xaa can be any naturally occurring amino acid
  variant (383)..(383): Xaa can be any naturally occurring amino acid
  variant (390)..(390): Xaa can be any naturally occurring amino acid
  variant (420)..(420): Xaa can be any naturally occurring amino acid
  variant (429)..(429): Xaa can be any naturally occurring amino acid
  variant (449)..(449): Xaa can be any naturally occurring amino acid
  variant (475)..(475): Xaa can be any naturally occurring amino acid
MGARASVLSAGELDKWEKIRLRPGGKKKYRLKHIVWASRELERFAVNPGLLETSEGCRQILEQLQPSLQTGSEELRSLFNTVATLYCVHQKIEVKDTKEALDKIEEEQNKSKKKTQQAAAAADTGNKLQVSQNYPIVQNLQGQMVHQALSPRTLNAWVKVIEEKXFSPEVIPMFTALSXGXTPQDLNTMXNTVGGHQAAMXMLKETINEEAAEWDRLHPVQAGPVAPGQLXEPRGSDIAGTXSNXQXQIAWMTHNPPIPVGEIYKRWIILGLNKIVRMXSPISILEIRQGPKEPFRDYVDRFYKTLRAXQASXEVKNWMTETLLVQNANPXCKTILKALGPGATLEEMMTACQGVGGPAHKXRVLAEAMSQVTNSNAXMMQRXNFRNQRXPVKCFNCGKEGHIARNCRAPRKKGCWKCGXEGHQMKDCXERQANFLGKIWPSHKGRPGXFLQSRPEPSAPPEESFRFGEETTTPXQKQGAIDKELYPLTSLRSLFGNDPSSQ

SEQ ID NO: 689 - protein, 501 aa, Human immunodeficiency virus
MGARASVLSGGELDRWEKIRLRPGGRKKYRLKHIVWASRELERFAVNPGLLETSEGCRQILGQLQPSLQTGSEELRSLYNTVATLYCVHQKIDVKDTKEALDKIEEEQNKSKKKAQQAAADSKQGSGSVSQNYPIVQNLQGQMVHQAISPRTLNAWVKVIEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPISILDIKQGPKEPFRDYVDRFYKTLRAEQATQEVKNWMTETLLVQNANPDCKTILKALGPAATLEEMMTACQGVGGPGHKARVLAEAMSQMTNSATIMMQKGNFRNQRKSVKCFNCGKEGHIAKNCRAPRRRGCWKCGKEGHQMKDCTERQANFLGKIWPSHKGRPGNFLQSRPEPTAPPAESFKFGEETTTPPQKQETGDKELYPLASLRSLFGNDPLSQ

SEQ ID NO: 690 - protein, 505 aa, Human immunodeficiency virus
MGARASVLSGGQLDRWEKIRLRPGGKKQYKLKHIVWASRELERFAVNPGLLETAEGCRQILGQLQPSLQTGSEELRSLFNTVATLYCVHQRIDVKDTKEALDKIEEEQNKSKKQAQQAAAAADTGNSSKVSQNYPIVQNLQGQMVHQPISPRTLNAWVKVVEEKAFSPEVIPMFTALSEGATPQDLNTMLNTVGGHQAAMQMLKETINEEAAEWDRLHPVQAGPIAPGQIREPRGSDIAGTTSTLQEQITWMTNNPPIPVGEIYKRWIVLGLNKIVRMYSPTSILDIKQGPKEPFRDYVDRFYRTLRAEQASQEVKNWMTETLLVQNANPDCKTILKALGPGATLEEMMSACQGVGGPGHKARVLAEAMSQVNSSAIMMQRGNFRNQRKTVKCFNCGKEGHIAKNCRAPRKKGCWKCGKEGHQMKDCTERQANFLGKIWPSHKGRPGNFLQSRPESRPEPTAPPEESFRFGEETTTPPQKQDTIEKELYPLASLRSLFGSDPSSQ

SEQ ID NO: 691 - protein, 500 aa, Artificial Sequence
  Tailored vaccine antigen episensus sequence
MGARASVLSGGELDRWEKIRLRPGGKKKYKLKHIVWASRELERFAVNPGLLETSEGCRQILGQLQPSLQTGSEELKSLYNTVATLYCVHQKIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 692 - protein, 502 aa, Artificial Sequence
  Tailored vaccine antigen 1 sequence
MGARASVLSGGELDKWEKIRLRPGGKKKYRLKHIVWASRELERFAVNPGLLETSGGCRQILEQLQPSLQTGSEELRSLYNTVATLYCVHQKIDVKDTKEALEKIEEEQNKSKKKAQQAAAAADTGNNSQVSQNYPIVQNMQGQMVHQALSPRTLNAWVKVIEEKAFSPEVIPMFTALSEGATPQDLNTMLNSVGGHQAAMQMLKETINEEAAEWDRVHPVHAGPVAPGQMREPRGSDIAGTTSTLQEQIGWMTSNPPIPVGEIYKRWIIMGLNKIVRMYSPTSILDIKQGPKEPFRDYVDRFYKTLRAEQATQEVKNWMTETLLVQNSNPDCKTILKALGPGATLEEMMTACQGVGGPSHKARVLAEAMSQATNSATIMMQKGNFRNQRKIVKCFNCGKEGHIAKNCRAPRKKGCWKCGREGHQMKDCTERQVNFLGKIWPSHKGRPGNFLQNRPEPTAPPAESFRFGEETTTPPQKQEPIDKELYPLASLKSLFGNDPSSQ

SEQ ID NO: 693 - protein, 500 aa, Artificial Sequence
  Tailored vaccine antigen 2 sequence
MGARASVLSGGKLDKWEKIRLRPGGKKRYKLKHIVWASRELERFAVNPGLLETAEGCRQILGQLQPALQTGSEELKSLFNTVATLYCVHQRIDVKDTKEALEKIEEEQNKSKKKAQPAAADTGSSSQVSQNYPIVQNMQGQMVHQAISPRTLNAWVKVIEEKAFSPEVIPMFAALSEGATPQDLNLMLNTVGGHQAAMQMLKETINEEAAEWDRLHPVHAGPVAPGQMREPRGSDIAGTTSTLQEQIGWMTHNPPIPVGEIYKKWIIMGLNKIVRMYSPTSILDIKQGPKEPFRDYVDRFYKTLRAEQATQEVKNWMTETLLVQNSNPDCKTILKALGPGATLEEMMTACQGVGGPSHKARVLAEAMSQATNSATIMMQRGNFKNQRKTIKCFNCGKEGHIAKNCRAPRKKGCWKCGREGHQMKDCTERQANFLGKIWPSHKGRPGNFLQNRPEPTAPPAESFRFGEETTTPPQKQEPIDKELYPLASLKSLFGNDPSSQ

SEQ ID NO: 694 - protein, 502 aa, Artificial Sequence
  Tailored vaccine antigen 3 sequence
MGARASVLSGGELDKWEKIRLRPGGKKKYRLKHIVWASRELERFAVNPGLLETAEGCRQILEQLQPSLQTGSEELRSLYNTVAVLYCVHQRIDVKDTKEALDKIEEEQNKSKKKAQQAAAAADTGNNSQVSQNYPIVQNLQGQMVHQPISPRTLNAWVKVIEEKAFSPEVIPMFTALSEGATPQDLNTMLNTVGGHQAAMQMLKDTINEEAAEWDRLHPVQAGPIAPGQIREPRGSDIAGTTSTLQEQIAWMTNNPPIPVGDIYKRWIILGLNKIVRMYSPTSILDIKQGPKEPFRDYVDRFYKTLRAEQASQDVKNWMTETLLVQNSNPDCKTILKALGPGATLEEMMTACQGVGGPSHKARVLAEAMSQATNSATIMMQKGNFRNQRKIVKCFNCGKEGHIAKNCRAPRKKGCWKCGREGHQMKDCTERQANFLGKIWPSSKGRPGNFLQSRPEPTAPPAESFRFGEETTTPPQKQEPIDKELYPLASLKSLFGNDPSSQ

SEQ ID NO: 695 - protein, 501 aa, Artificial Sequence
  Tailored vaccine antigen 4 sequence
MGARASVLSGGKLDKWEKIRLRPGGKKKYRLKHIVWASRELERFAVNPGLLETAEGCRQILGQLQPALQTGSEELRSLYNTVATLYCVHQRIEVKDTKEALEKIEEEQNKSKKKVQQAAAADTGNSNQVSQNYPIVQNIQGQMVHQPLSPRTLNAWVKVIEEKAFSPEVIPMFTALSEGATPQDLNTMLNTIGGHQAAMQMLKETINEEAADWDRLHPVHAGPVAPGQMREPRGSDIAGTTSNLQEQIGWMTSNPPIPVGEIYKRWIIMGLNKIVRMYSPTSILDIKQGPKEPFRDYVDRFYKTLRAEQASQDVKNWMTETLLVQNSNPDCKTILKALGPGATLEEMMTACQGVGGPSHKARVLAEAMSQVTNSATIMMQKGNFRNQRKIVKCFNCGKEGHIAKNCRAPRKRGCWKCGKEGHQMKECTERQANFLGKIWPSYKGRPGNFLQSRPEPSAPPEESFRFGEETATPSQKQEPIDKELYPLASLKSLFGNDPSSQ

SEQ ID NO: 696 - protein, 500 aa, Artificial Sequence
  Tailored vaccine antigen 5 sequence
MGARASVLSGGKLDKWEKIRLRPGGKKQYKLKHLVWASRELERFAVNPGLLETAEGCRQILGQLQPALQTGSEELKSLFNTVATLYCVHQRIDVKDTKEALEKIEEEQNKSKKKAQQAAADTGNNSQVSQNYPIVQNIQGQMVHQALSPRTLNAWVKVIEEKAFSPEVIPMFSALAEGATPQDLNTMLNTVGGHQAAMQILKETINEEAAEWDRLHPVQAGPVAPGQMREPRGSDIAGTTSNLQEQIAWMTHNPPIPVGEIYKRWIIMGLNKIVRMYSPVSILDIRQGPKEPFRDYVDRFYKTLRAEQASQDVKNWMTETLLVQNSNPDCKTILKALGPGATLEEMMTACQGVGGPSHKARVLAEAMSQATNPATIMMQRGNFKNQRKIVKCFNCGKEGHIAKNCRAPRKKGCWKCGKEGHQMKECTERQANFLGKIWPSYKGRPGNFLQSRPEPSAPPEESFRFGEETTTPPQKQEPIDKELYPLTSLRSLFGNDPSSQ

SEQ ID NO: 697 - protein, 500 aa, Artificial Sequence
  EpiGraph antigen 1 sequence
MGARASVLSGGELDRWEKIRLRPGGKKKYKLKHIVWASRELERFAVNPGLLETSEGCRQILGQLQPSLQTGSEELKSLYNTVATLYCVHQRIDVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 698 - protein, 500 aa, Artificial Sequence; identical to SEQ ID NO: 697
  Epigraph cocktail antigen 1

SEQ ID NO: 699 - protein, 502 aa, Artificial Sequence
  Epigraph cocktail antigen 2
MGARASVLSGGKLDKWEKIRLRPGGKKKYRLKHIVWASRELERFALNPGLLETAEGCRQILGQLQPALQTGSEELKSLFNTVATLYCVHQKIDVKDTKEALEKIEEEQNKSKKKAQQAAAAADTGNNSQVSQNYPIVQNMQGQMVHQALSPRTLNAWVKVIEEKAFSPEVIPMFTALSEGATPQDLNLMLNTVGGHQAAMQILKETINEEAADWDRLHPVHAGPVAPGQMREPRGSDIAGTTSNLQEQIGWMTSNPPIPVGEIYKRWIIMGLNKIVRMYSPVSILDIKQGPKEPFRDYVDRVYKTLRAEQASQDVKNWMTETLLVQNSNPDCKTILKALGPGATLEEMMTACQGVGGPSHKARVLAEAMSQATNSATIMMQKGNFRNQRKIVKCFNCGKEGHIAKNCRAPRKRGCWKCGKEGHQMKECTERQANFLGKIWPSYKGRPGNFLQNRPEPTAPPAESFRFGEETTTPPQKQEPIDKELYPLASLKSLFGNDPSSQ

SEQ ID NO: 700 - protein, 500 aa, Artificial Sequence
  Epigraph cocktail antigen 3
ARASVLSGGELDKWEKIRLRPGGKKQYKLKHLVWASRELERFAINPGLLETSGGCRQILEQLQPSLQTGSEELRSLYNTVAVLYCVHQRIEVKDTKEALEKVEEEQNKSKKKVQQAAADTGNSNQVSQNYPIVQNIQGQMVHQPISPRTLNAWVKVIEDKAFSPEVIPMFAALSEGATPQDLNTMLNTIGGHQAAMQMLKDTINEEAAEWDRLHPVQAGPVAPGQMRDPRGSDIAGTTSTLQEQIAWMTNNPPIPVGDIYKRWIILGLNKIVRMYSPTSILDIKQGPKESFRDYVDRFYKTLRAEQATQEVKNWMTETLLVQNANPDCRTILKALGPAATLEEMMSACQGVGGPSHKARILAEAMSQVTNSTAIMMQRGNFKNQRKTVKCFNCGREGHIAKNCRAPRKKGCWKCGREGHQMKDCTERQRQANFLGKIWPSSKGRPGNFLQSRPEPSAPPEESFRFGEETATPSQKQEPIDKELYPLTSLRSLFGNDPSLQ

SEQ ID NO: 701 - protein, 705 aa, Artificial Sequence
  HIV B gag/nef fusion Epigraph 1
MGARASVLSGGELDRWEKIRLRPGGKKKYRLKHIVWASRELERFAVNPGLLETSEGCRQILGQLQPSLQTGSEELKSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLKSLFGNDPSSQGGKWSKSSIVGWPAVRERMRRAEPAAEGVGAVSRDLEKHGAITSSNTAATNADCAWLEAQEEEEVGFPVRPQVPLRPMTYKGALDLSHFLKEKGGLEGLIYSQKRQDILDLWVYHTQGYFPDWQNYTPGPGIRYPLTFGWCFKLVPVEPEKVEEANEGENNSLLHPMSQHGMDDPEKEVLMWKFDSRLAFHHMARELHPEYYKDC

SEQ ID NO: 702 - protein, 706 aa, Artificial Sequence
  HIV B gag/nef fusion Epigraph 2
MGARASVLSGGKLDKWEKIRLRPGGKKKYKLKHIVWASRELERFALNPGLLETSEGCKQILGQLQPALQTGSEELRSLYNTVAVLYCVHQRIDVKDTKEALEKIEEEQNKCKKKAQQAAAAADTGNNSQVSQNYPIVQNMQGQMVHQALSPRTLNAWVKVIEEKAFSPEVIPMFTALSEGATPQDLNTMLNTIGGHQAAMQMLKDTINEEAAEWDRVHPVHAGPVAPGQMREPRGSDIAGTTSNLQEQIAWMTHNPPIPVGEIYKRWIIMGLNKIVRMYSPVSILDIKQGPKEPFRDYVDRFYRTLRAEQASQDVKNWMTETLLVQNSNPDCKTILKALGPGATLEEMMTACQGVGGPSHKARVLAEAMSQVTNSATIMMQKGNFRNQRKIVKCFNCGKEGHIARNCRAPRKRGCWKCGKEGHQMKECTERQANFLGKIWPSYKGRPGNFLQNRPEPTAPPAESFRFGEETATPPQKQEPIDKEMYPLASLRSLFGNDPSQGGKWSKRSVPGWNTIRERMRRTEPAAEGVGAASRDLERHGAITSSNTAANNAACAWLEAQEDEEVGFPVKPQVPLRPMTYKAAVDLSHFLKEKGGLEGLIHSQKRQEILDLWVYNTQGYFPDWHNYTPGPGTRFPLTFGWCFKLVPVDPEQVEKANEGENNCLLHPMSLHGMDDPEREVLVWKFDSRLAFHHVAREKHPEYYKDC

SEQ ID NO: 703 - protein, 992 aa, Artificial Sequence
  HIV B pol Epigraph 1
MFFRENLAFPQGKAREFSSEQTRANSPTRRELQVWGRDNNSLSEAGADRQGTVSFSFPQITLWQRPLVTIKIGGQLKEALLADDTVLEEMNLPGRWKPKMIGGIGGFIKVRQYDQIPIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQLYVGSDLEIGQHRTKIEELRQHLLRWGFTTPDKKHQKEPPFLWMGYELHPDKWTVQPIVLPEKDSWTVNDIQKLVGKLNWASQIYAGIKVKQLCKLLRGTKALTEVVPLTEEAELELAENREILKEPVHGVYYDPSKDLIAEIQKQGQGQWTYQIYQEPFKNLKTGKYARMRGAHTNDVKQLTEAVQKIATESIVIWGKTPKFKLPIQKETWEAWWTEYWQATWIPEWEFVNTPPLVKLWYQLEKEPIVGAETFYVDGAANRETKLGKAGYVTDRGRQKVVSLTDTTNQKTQAIHLALQDSGLEVNIVTDSQYALGIIQAQPDKSESELVSQIIEQLIKKEKVYLAWVPAHKGIGGNEQVDKLVSAGIRKVLFLDGIDKAQEEHEKYHSNWRAMASDFNLPPVVAKEIVASCDKCQLKGEAMHGQVDCSPGIWQLCTHLEGKIILVAVHVASGYIEAEVIPAETGQETAYFLLKLAGRWPVKTIHTNGSNFTSTTVKAACWWAGIKQEFGIPYNPQSQGVVSMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 704 - protein, 993 aa, Artificial Sequence
  HIV B pol Epigraph 2
MFFREDLAFPQGEAREFPSEQTRANSPTSRELQVWGGDNNSPSEAGADRQGTVSLSFPQITLWQRPLVTVKIGGQLKEALLADDTVLEEMSLPGKWKPKMIGGIGGFIKVRQYDQVPIEICGHKTIGTVLIGPTPVNIIGRNLLTQLGCTLNFPISPIETVPVKLKPGMDGPRVKQWPLTEEKIKALIEICTEMEKEGKISRIGPENPYNTPIFAIKKKDSTKWRKLVDFRELNKKTQDFWEVQLGIPHPSGLKKKKSVTVLDVGDAYFSVPLDKEFRKYTAFTIPSTNNETPGIRYQYNVLPQGWKGSPAIFQCSMTKILEPFRKQNPEIVIYQLYVGSDLEIGQHRAKIEELRQHLLKWGFTTPDKKHQKEPPFLWMGYELHPDKWTVQPIELPEKDSWTVNDIQKLVGKLNWASQIYPGIKVRQLCKLLRGAKALTEVIPLTKEAELELAENREILREPVHGVYYDPTKDLIAEIQKQGLGQWTYQIYQEPFKNLKTGKYARTRGAHTNDVRQLTEAVQKITTESIVIWGKTPKFRLPIQKETWETWWTEYWQATWIPEWEFVNTPPLVKLWYQLEKEPIIGAETFYVDGASNRETKLGKAGYVTNRGRQKVISLTDTTNQKTLQAIYLALQDSGSEVNIVTDSQYALGIIQAQPDQSESELVNQIIEQLINKEKVYLAWVPAHKGIGGNEQVDKLVSTGIRKVLFLDGIDRAQEEHEKYHNNWRAMASDFNLPPIVAKEIVASCDKCQLKGEAIHGQVDCSPGIWQLCTHLEGKVILVAVHVASGYIEAEVIPAETGQETAYFILKLAGRWPVKTVHTNGSNFTSATVKAACWWAGVKQEFGIPYNPQSQGVVSMNNELKKIIGQIRDQAEHLKTAVQMAVFIHNFKRKGGIGEYSAGERIIDIIATDIQTRELQKQITKIQNFRVYYRDNRDPLWKGPAKLLWKGEGAVVIQDNSEIKVVPRRKVKIIRDYGKQMAGDDCVAGRQDED

SEQ ID NO: 705 - protein, 704 aa, Artificial Sequence
  HIV M gag/nef fusion Epigraph 1
MGARASVLSGGKLDAWEKIRLRPGGKKKYRLKHLVWASRELERFALNPGLLETSEGCRQILGQLQPSLQTGSEELKSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSATIMMQRGNFKGQKRIKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLKSLFGNDPLSQGGKWSKSSIVGWPAVRERMRRAEPAAEGVGAVSRDLEKHGAITSSNTAATNADCAWLEAQEEEEVGFPVRPQVPLRPMTYKGALDLSHFLKEKGGLEGLIYSKKRQEILDLWVYHTQGYFPDWQNYTPGPGIRYPLTFGWCFKLVPVDPREVEEANEGENNCLLHPMSQHGMDDPEKEVLMWKFDSRLAFHHMARELHPEYYKDC

SEQ ID NO: 706 - protein, 314 aa, Artificial Sequence
  HIV M gag/nef conserved Epigraph 1
MPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLVGFPVRPQVPLRPMTYKGALDLSHFLKEKGGLEGLIYSKKRQEILDLWVYHTQGYFPDWQNYTPGPGIRYPLTFGWCFKLVP

SEQ ID NO: 707 - protein, 701 aa, Artificial Sequence
  HIV M gag/nef fusion Epigraph 2
MGARASVLSGGELDRWEKIRLRPGGKKKYKLKHIVWASRELERFAVNPGLLETAEGCQQIIEQLQSTLKTGSEELKSLFNTVAVLYCVHQRIDVKDTKEALEKIEEEQNKSQQKTQQAAAGTGSSSKVSQNYPIVQNAQGQMVHQPLSPRTLNAWVKVIEEKAFSPEVIPMFTALSEGATPQDLNMMLNIVGGHQAAMQMLKDTINEEAAEWDRVHPVHAGPIPPGQMREPRGSDIAGTTSNLQEQIGWMTSNPPIPVGDIYKRWIILGLNKIVRMYSPTSILDIKQGPKEPFRDYVDRFFKTLRAEQASQEVKNWMTDTLLVQNANPDCKTILRALGPGATLEEMMTACQGVGGPSHKARVLAEAMSQVTNSATIMMQRGNFRNQRKTVKCFNCGKEGHLARNCRAPRKKGCWKCGREGHQMKDCNERQANFLGKIWPSNKGRPGNFPQSRPEPTAPPAESFRFEETTPAPKQEPKDREPLTSLKSLFGSDPLSQGSKWSKSSIVGWPAIRERMRRTEPAAEGVGAASRDLERHGAITSSNTAANNADCAWLEAQEDEEVGFPVKPQVPLRPMTYKAAFDLSFFLKEKGGLDGLIYSQKRQDILDLWVYNTQGFFPDWQNYTPGPGVRYPLTFGWCFKLVPVEPEKVEEANEGENNSLLHPMSLHGMDDPEREVLMWKFDSSLARRHMARELHPEFYKDC

SEQ ID NO: 708 - protein, 314 aa, Artificial Sequence
  HIV M gag/nef conserved Epigraph 2
MPIVQNAQGQMVHQPLSPRTLNAWVKVIEEKAFSPEVIPMFTALSEGATPQDLNMMLNIVGGHQAAMQMLKDTINEEAAEWDRVHPVHAGPIPPGQMREPRGSDIAGTTSNLQEQIGWMTSNPPIPVGDIYKRWIILGLNKIVRMYSPTSILDIKQGPKEPFRDYVDRFFKTLRAEQASQEVKNWMTDTLLVQNANPDCKTILRALGPGATLEEMMTACQGVGGPSHKARVLVGFPVKPQVPLRPMTYKAAFDLSFFLKEKGGLDGLIYSQKRQDILDLWVYNTQGFFPDWQNYTPGPGVRYPLTFGWCFKLVP

SEQ ID NO: 709 - protein, 994 aa, Artificial Sequence
  HIV M pol Epigraph 1
MFFRENLAFPQGEAREFSSEQTRANSPTRRELQVWGRDNNSLSEAGADRQGTVSFSFPQITLWQRPLVTIKIGGQLKEALLADDTVLEDINLPGKWKPKMIGGIGGFIKVRQYDQILIEICGKKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQLYVGSDLEIGQHRTKIEELRQHLLKWGFTTPDKKHQKEPPFLWMGYELHPDKWTVQPIVLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYARMRGAHTNDVKQLTEAVQKIATESIVIWGKTPKFRLPIQKETWETWWTEYWQATWIPEWEFVNTPPLVKLWYQLEKEPIVGAETFYVDGAANRETKLGKAGYVTDRGRQKVVSLTETTNQKTLQAIHLALQDSGSEVNIVTDSQYALGIIQAQPDKSESELVNQIIEQLIKKEKVYLSWVPAHKGIGGNEQVDKLVSSGIRKVLFLDGIDKAQEEHEKYHSNWRAMASDFNLPPIVAKEIVASCDKCQLKGEAMHGQVDCSPGIWQLCTHLEGKVILVAVHVASGYIEAEVIPAETGQETAYFLLKLAGRWPVKVIHTNGSNFTSAAVKAACWWAGIKQEFGIPYNPQSQGVVSMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDEDQ

SEQ ID NO: 710 - protein, 599 aa, Artificial Sequence
  HIV M pol conserved Epigraph 1
MPQITLWQRPLVTIKIGGQLKEALLADDTVLEDINLPGKWKPKMIGGIGGFIKVRQYDQILIEICGKKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQLYVGSDLEIGQHRTKIEELRQHLLKWGFTTPDKKHQKEPPFLWMGYELHPDKWTVQPIVLPEKDSWTVNDIQKLVGKLNWASQIYHGQVDCSPGIWQLCTHLEGKVILVAVHVASGYIEAEVIPAETGQETAYFLLKLAGRWPVKVIHTNGSNFTSAAVKAACWWAGIKQEFGIPYNPQSQGVVSMNKELKKIIGQVRDQAEHLKTAVQMAVFIHNFKRKGGIGGYSAGERIIDIIATDIQTKLQKQITKIQNFRVYYRDSRDPIWKGPAKLLWKGEGAVVIQDNSDIKVVPRRKAKIIRDYGKQMAGDDCVAGRQDEDQ

SEQ ID NO: 711 - protein, 993 aa, Artificial Sequence
  HIV M pol Epigraph 2
MFFREDLAFPQGKAREFPSEQTRANSPTRGELQVWGGDNNSPSEAGADRQGTVSFSFPQITLWQRPLVSIKVGGQIKEALLADDTVLEEMNLPGRWKPKMIGGIGGFIKVRQYDQIPIEICGHKAIGTVLIGPTPVNIIGRNMLTQLGCTLNFPISPIDTVPVTLKPGMDGPRVKQWPLTEEKIKALTEICKEMEKEGKITKIGPENPYNTPIFAIKKKDSTKWRKLVDFRELNKKTQDFWEVQLGIPHPAGLKKKKSVTVLDVGDAYFSVPLDESFRKYTAFTIPSTNNETPGIRYQYNVLPQGWKGSPAIFQCSMTKILEPFRIKNPEIVIYQLYVGSDLEIGQHRAKIEELREHLLRWGFTTPDKKHQKEPPFLWMGYELHPDRWTVQPIELPEKDSWTVNDIQKLVGKLNWASQIYAGIKVRQLCKLLRGTKALTEVVPLTEEAELELAENREILKTPVHGVYYDPSKDLVAEIQKQGQGQWTYQIYQEPYKNLKTGKYARKRSAHTNDVRQLTEVVQKIATESIVIWGKTPKFKLPIQKETWEAWWTDYWQATWIPDWEFVNTPPLVKLWYQLEKDPIVGAETFYVDGAASRETKLGKAGYVTNRGRQKVVSLTDTTNQKTLHAIHLALQDSGLEVNIVTDSQYALGIIQAQPDRSESEVVNQIIEELIKKEKVYLAWVPAHKGIGGNEQVDKLVSAGIRKVLFLDGIDKAQEEHERYHSNWRTMASDFNLPPVVAKEIVANCDKCQLKGEAIHGQVDCSPGMWQLCTHLEGKIILVAVHVASGYMEAEVIPAETGQETAYFILKLAGRWPVKTIHTNGSNFTSTTVKAACWWAGIQQEFGIPYNPQSQGVVSMNNELKKIIGQVREQAEHLKTAVQMAVFIHNFKRRGGIGGYSAGERIVDIIATDIQTRELQKQIIKIQNFRVYYRDSRDPLWKGPAKLLWKGEGAVVIQDNSEIKVVPRRKVKIIKDYGKQMAGDDCVASRQDED

SEQ ID NO: 712 - protein, 598 aa, Artificial Sequence
  HIV M pol conserved Epigraph 2
MPQITLWQRPLVSIKVGGQIKEALLADDTVLEEMNLPGRWKPKMIGGIGGFIKVRQYDQIPIEICGHKAIGTVLIGPTPVNIIGRNMLTQLGCTLNFPISPIDTVPVTLKPGMDGPRVKQWPLTEEKIKALTEICKEMEKEGKITKIGPENPYNTPIFAIKKKDSTKWRKLVDFRELNKKTQDFWEVQLGIPHPAGLKKKKSVTVLDVGDAYFSVPLDESFRKYTAFTIPSTNNETPGIRYQYNVLPQGWKGSPAIFQCSMTKILEPFRIKNPEIVIYQLYVGSDLEIGQHRAKIEELREHLLRWGFTTPDKKHQKEPPFLWMGYELHPDRWTVQPIELPEKDSWTVNDIQKLVGKLNWASQIYHGQVDCSPGMWQLCTHLEGKIILVAVHVASGYMEAEVIPAETGQETAYFILKLAGRWPVKTIHTNGSNFTSTTVKAACWWAGIQQEFGIPYNPQSQGVVSMNNELKKIIGQVREQAEHLKTAVQMAVFIHNFKRRGGIGGYSAGERIVDIIATDIQTRLQKQIIKIQNFRVYYRDSRDPLWKGPAKLLWKGEGAVVIQDNSEIKVVPRRKVKIIKDYGKQMAGDDCVASRQDED

SEQ ID NO: 713 - protein, 773 aa, Artificial Sequence
  SIV gag/nef hybrid
MGARGSVLSGKKTDELEKVRLRPGGRKKYMLKHIVWAARELDRFGSAESLLESKEGCQRILAVLAPLMPTGSEDLKSLFSTVCVVWCLHAEMKVKDTEEAKKTVQSHLVVESGTAETMPAQSRPTAPPSGRGGNYPVQQIGGNYVHLPLSPRTLNAWVKLIEEKKFGAEVVPGFQALSEGCTPYDINQMLNCVGDHQAAMQIIRDIINEEAADWDLQHPQPAPQQGQLREPSGSDIAGTTSSVDEQIQWMYRQQNPIPVGNIYRRWIQLGLQKCVRMYNPTNILDVKQGPKEPFQSYVDRFYKSLRAEQTDAAVKNWMTQTLLIQNANPDCKLVLKGLGVNPTLEEMLTACQGVGGPGQKARLMAEALKDALTPGPIPFAAVQQRGQRKIIKCWNCGKTGHSARQCKAPRRKGCWKCGKAGHVMAKCPERQAGFLGFGPWGKKPHNFPMAQMPQGLTPTAPPADPAVDMLKNYMKMGKRQREKQRENRERPYKEVSEDLLHLSSLFGEDQPGGATSKRRSKPSGDLRQKLLRARGENYGRLWGELEDGSSQSLGGLGKGLSSRSCEGQKYSQGQFMNTPWKNPAEEKEKLPYRKQNIDDVDEEDNDLVGVSVRPKVPLRTMSYKLAIDMSHFIKEKGGLEGIYYSARRHRILDIYLEKEEGIIPDWQDYTSGPGIRYPKTFGWLWKLVPVDMSNEAQEDDTHYLVHPAQTHQWSDPWGEVLVWKFDPLLAHTYEAFVRHPEEFGWKSGLPKEEVERRLAARGLLKMADKKETR

SEQ ID NO: 714 - protein, 312 aa, Artificial Sequence
  SIV gag/nef conserved
MPVQQIGGNYVHLPLSPRTLNAWVKLIEEKKFGAEVVPGFQALSEGCTPYDINQMLNCVGDHQAAMQIIRDIINEEAADWDLQHPQPAPQQGQLREPSGSDIAGTTSSVDEQIQWMYRQQNPIPVGNIYRRWIQLGLQKCVRMYNPTNILDVKQGPKEPFQSYVDRFYKSLRAEQTDAAVKNWMTQTLLIQNANPDCKLVLKGLGVNPTLEEMLTACQGVGGPGQKARLMVGVSVRPKVPLRTMSYKLAIDMSHFIKEKGGLEGIYYSARRHRILDIYLEKEEGIIPDWQDYTSGPGIRYPKTFGWLWKLVP

SEQ ID NO: 715 - protein, 1009 aa, Artificial Sequence
  SIV pol hybrid
MFFRAWPMGKEASQFPHGPDASGADTNCSPRGSSCGSTEELHEVGQKAERKAEGEQRETLQGGNGGFAAPQFSLWRRPVVTAHIEGQPVEVLLADDSIVTGIELGPHYTPKIVGGIGGFINTKEYKNVEIEVLGKRIKGTIMTGDTPINIFGRNLLTALGMSLNFPIAKVEPVKVALKPGKDGPKLKQWPLSKEKIVALREICEKMEKDGQLEEAPPTNPYNTPTFAIKKKDKNKWRMLIDFRELNRVTQDFTEVQLGIPHPAGLAKRKRITVLDIGDAYFSIPLDEEFRQYTAFTLPSVNNAEPGKRYIYKVLPQGWKGSPAIFQYTMRHVLEPFRKANPDVTLVQILIASDRTDLEHDRVVLQSKELLNSIGFSTPEEKFQKDPPFQWMGYELWPTKWKLQKIELPQRETWTVNDIQKLVGVLNWAAQIYPGIKTKNLCKMIRGKMALTEGVQWTELAEAELEENRIILNQEQEGRYYREDKPLEATVLKNQDNQWTYKIHQGDRILKVGKYAKVKNTHTNGIRLLANVVQKIGKESIVIWGQTPFFHLPVEREVWDQWWTDYWQATWIPDWDFVSTPPLIRLVFNLVKEPIEKEEVYYIDGSCNRNSKEGKAGYVTDRGKEKVLVLEQATNQQALQAFLLALKDSGPKANIVTDSQYVLGIITGQPTESDSRIVAQIIEQMIKKSEVYIGWVPAHKGLGGNQEVDRLVSQEIRQVLFLESIEPAQEDHDKYHSNIKELAFKFGLPRLVAKQIVDTCNKCQQKGEAIHGQANSDLGTWQMCTHLEGKIIIVAVHVASGFIEAEVIPQETGRQTALFLLKLAGRWPITHLHTNGANFASQEVKMVAWWAGIEHTFGVPYNPQSQGVVAMNHHLKNQIDRIREQANSVETIVLMAVHCMNFKRRGGIGDMTPAERLINMITTEQEIQFQQSKNSKFKNFRVYYREGRDQLWKGPGELLWKGEGAVILKVGTDIKVVPRRKAKIIKDYGGGKEVDSSSHMEDTGEAREVA

SEQ ID NO: 716 - protein, 604 aa, Artificial Sequence
  SIV pol conserved
MPQFSLWRRPVVTAHIEGQPVEVLLADDSIVTGIELGPHYTPKIVGGIGGFINTKEYKNVEIEVLGKRIKGTIMTGDTPINIFGRNLLTALGMSLNFPIAKVEPVKVALKPGKDGPKLKQWPLSKEKIVALREICEKMEKDGQLEEAPPTNPYNTPTFAIKKKDKNKWRMLIDFRELNRVTQDFTEVQLGIPHPAGLAKRKRITVLDIGDAYFSIPLDEEFRQYTAFTLPSVNNAEPGKRYIYKVLPQGWKGSPAIFQYTMRHVLEPFRKANPDVTLVQILIASDRTDLEHDRVVLQSKELLNSIGFSTPEEKFQKDPPFQWMGYELWPTKWKLQKIELPQRETWTVNDIQKLVGVLNWAAQIYHGQANSDLGTWQMCTHLEGKIIIVAVHVASGFIEAEVIPQETGRQTALFLLKLAGRWPITHLHTNGANFASQEVKMVAWWAGIEHTFGVPYNPQSQGVVAMNHHLKNQIDRIREQANSVETIVLMAVHCMNFKRRGGIGDMTPAERLINMITTEQEIQFQQSKNSKFKNFRVYYREGRDQLWKGPGELLWKGEGAVILKVGTDIKVVPRRKAKIIKDYGGGKEVDSSSHMEDTGEAREVA

SEQ ID NO: 717 - protein, 1003 aa, Artificial Sequence
  HIV B pol epigraph1
FFRENLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQIPIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVKQLCKLLRGTKALTEVVPLTEEAELELAENREILKEPVHGVYYDPSKDLIAEIQKQGQGQWTYQIYQEPFKNLKTGKYARMRGAHTNDVKQLTEAVQKIATESIVIWGKTPKFKLPIQKETWEAWWTEYWQATWIPEWEFVNTPPLVKLWYQLEKEPIVGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 718 - protein, 499 aa, Artificial Sequence
  HIV M gag Epigraph1
MGARASVLSGGKLDAWEKIRLRPGGKKKYRLKHLVWASRELERFALNPGLLETSEGCRQILGQLQPSLQTGSEELKSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSATIMMQRGNFKGQKRIKCFNCGKEGHIARNCRAPRKKGCWKCGKEGHQMKDCTERQANFLGKIWPSHKGRPGNFLQSRPEPTAPPEESFRFGEETTTPSQKQEPIDKELYPLASLKSLFGNDPLSQ

SEQ ID NO: 719 - protein, 231 aa, Artificial Sequence
  HIV M gag Epigraph1 Conserved
PIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVL

SEQ ID NO: 720 - protein, 496 aa, Artificial Sequence
  HIV M gag Epigraph2
MGARASVLSGGELDRWEKIRLRPGGKKKYKLKHIVWASRELERFAVNPGLLETAEGCQQIIEQLQSTLKTGSEELKSLFNTVAVLYCVHQRIDVKDTKEALEKIEEEQNKSQQKTQQAAAGTGSSSKVSQNYPIVQNAQGQMVHQPLSPRTLNAWVKVIEEKAFSPEVIPMFTALSEGATPQDLNMMLNIVGGHQAAMQMLKDTINEEAAEWDRVHPVHAGPIPPGQMREPRGSDIAGTTSNLQEQIGWMTSNPPIPVGDIYKRWIILGLNKIVRMYSPTSILDIKQGPKEPFRDYVDRFFKTLRAEQASQEVKNWMTDTLLVQNANPDCKTILRALGPGATLEEMMTACQGVGGPSHKARVLAEAMSQVTNSATIMMQRGNFRNQRKTVKCFNCGKEGHLARNCRAPRKKGCWKCGREGHQMKDCNERQANFLGKIWPSNKGRPGNFPQSRPEPTAPPAESFRFEETTPAPKQEPKDREPLTSLKSLFGSDPLSQ

SEQ ID NO: 721 - protein, 231 aa, Artificial Sequence
  HIV M gag Epigraph2 Conserved
PIVQNAQGQMVHQPLSPRTLNAWVKVIEEKAFSPEVIPMFTALSEGATPQDLNMMLNIVGGHQAAMQMLKDTINEEAAEWDRVHPVHAGPIPPGQMREPRGSDIAGTTSNLQEQIGWMTSNPPIPVGDIYKRWIILGLNKIVRMYSPTSILDIKQGPKEPFRDYVDRFFKTLRAEQASQEVKNWMTDTLLVQNANPDCKTILRALGPGATLEEMMTACQGVGGPSHKARVL

SEQ ID NO: 722 - protein, 206 aa, Artificial Sequence
  HIV M nef Epigraph1
MGGKWSKSSIVGWPAVRERMRRAEPAAEGVGAVSRDLEKHGAITSSNTAATNADCAWLEAQEEEEVGFPVRPQVPLRPMTYKGALDLSHFLKEKGGLEGLIYSKKRQEILDLWVYHTQGYFPDWQNYTPGPGIRYPLTFGWCFKLVPVDPREVEEANEGENNCLLHPMSQHGMDDPEKEVLMWKFDSRLAFHHMARELHPEYYKDC

SEQ ID NO: 723 - protein, 82 aa, Artificial Sequence
  HIV M nef Epigraph1 Conserved
VGFPVRPQVPLRPMTYKGALDLSHFLKEKGGLEGLIYSKKRQEILDLWVYHTQGYFPDWQNYTPGPGIRYPLTFGWCFKLVP

SEQ ID NO: 724 - protein, 206 aa, Artificial Sequence
  HIV M nef Epigraph2
MGSKWSKSSIVGWPAIRERMRRTEPAAEGVGAASRDLERHGAITSSNTAANNADCAWLEAQEDEEVGFPVKPQVPLRPMTYKAAFDLSFFLKEKGGLDGLIYSQKRQDILDLWVYNTQGFFPDWQNYTPGPGVRYPLTFGWCFKLVPVEPEKVEEANEGENNSLLHPMSLHGMDDPEREVLMWKFDSSLARRHMARELHPEFYKDC

SEQ ID NO: 725 - protein, 82 aa, Artificial Sequence
  HIV M nef Epigraph2 Conserved
VGFPVKPQVPLRPMTYKAAFDLSFFLKEKGGLDGLIYSQKRQDILDLWVYNTQGFFPDWQNYTPGPGVRYPLTFGWCFKLVP

SEQ ID NO: 726 - protein, 1004 aa, Artificial Sequence
  HIV M pol Epigraph1
FFRENLAFPQGEAREFSSEQTRANSPTRRELQVWGRDNNSLSEAGADRQGTVSFSFPQITLWQRPLVTIKIGGQLKEALLDTGADDTVLEDINLPGKWKPKMIGGIGGFIKVRQYDQILIEICGKKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLKWGFTTPDKKHQKEPPFLWMGYELHPDKWTVQPIVLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYARMRGAHTNDVKQLTEAVQKIATESIVIWGKTPKFRLPIQKETWETWWTEYWQATWIPEWEFVNTPPLVKLWYQLEKEPIVGAETFYVDGAANRETKLGKAGYVTDRGRQKVVSLTETTNQKTELQAIHLALQDSGSEVNIVTDSQYALGIIQAQPDKSESELVNQIIEQLIKKEKVYLSWVPAHKGIGGNEQVDKLVSSGIRKVLFLDGIDKAQEEHEKYHSNWRAMASDFNLPPIVAKEIVASCDKCQLKGEAMHGQVDCSPGIWQLDCTHLEGKVILVAVHVASGYIEAEVIPAETGQETAYFLLKLAGRWPVKVIHTDNGSNFTSAAVKAACWWAGIKQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDEDQ

SEQ ID NO: 727 - protein, 609 aa, Artificial Sequence
  HIV M pol Epigraph1 Conserved
PQITLWQRPLVTIKIGGQLKEALLDTGADDTVLEDINLPGKWKPKMIGGIGGFIKVRQYDQILIEICGKKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLKWGFTTPDKKHQKEPPFLWMGYELHPDKWTVQPIVLPEKDSWTVNDIQKLVGKLNWASQIYHGQVDCSPGIWQLDCTHLEGKVILVAVHVASGYIEAEVIPAETGQETAYFLLKLAGRWPVKVIHTDNGSNFTSAAVKAACWWAGIKQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDEDQ

SEQ ID NO: 728 - protein, 1003 aa, Artificial Sequence
  HIV M pol Epigraph2
FFREDLAFPQGKAREFPSEQTRANSPTRGELQVWGGDNNSPSEAGADRQGTVSFSFPQITLWQRPLVSIKVGGQIKEALLDTGADDTVLEEMNLPGRWKPKMIGGIGGFIKVRQYDQIPIEICGHKAIGTVLIGPTPVNIIGRNMLTQLGCTLNFPISPIDTVPVTLKPGMDGPRVKQWPLTEEKIKALTEICKEMEKEGKITKIGPENPYNTPIFAIKKKDSTKWRKLVDFRELNKKTQDFWEVQLGIPHPAGLKKKKSVTVLDVGDAYFSVPLDESFRKYTAFTIPSTNNETPGIRYQYNVLPQGWKGSPAIFQCSMTKILEPFRIKNPEIVIYQYMDDLYVGSDLEIGQHRAKIEELREHLLRWGFTTPDKKHQKEPPFLWMGYELHPDRWTVQPIELPEKDSWTVNDIQKLVGKLNWASQIYAGIKVRQLCKLLRGTKALTEVVPLTEEAELELAENREILKTPVHGVYYDPSKDLVAEIQKQGQGQWTYQIYQEPYKNLKTGKYARKRSAHTNDVRQLTEVVQKIATESIVIWGKTPKFKLPIQKETWEAWWTDYWQATWIPDWEFVNTPPLVKLWYQLEKDPIVGAETFYVDGAASRETKLGKAGYVTNRGRQKVVSLTDTTNQKTELHAIHLALQDSGLEVNIVTDSQYALGIIQAQPDRSESEVVNQIIEELIKKEKVYLAWVPAHKGIGGNEQVDKLVSAGIRKVLFLDGIDKAQEEHERYHSNWRTMASDFNLPPVVAKEIVANCDKCQLKGEAIHGQVDCSPGMWQLDCTHLEGKIILVAVHVASGYMEAEVIPAETGQETAYFILKLAGRWPVKTIHTDNGSNFTSTTVKAACWWAGIQQEFGIPYNPQSQGVVESMNNELKKIIGQVREQAEHLKTAVQMAVFIHNFKRRGGIGGYSAGERIVDIIATDIQTRELQKQIIKIQNFRVYYRDSRDPLWKGPAKLLWKGEGAVVIQDNSEIKVVPRRKVKIIKDYGKQMAGDDCVASRQDED

SEQ ID NO: 729 - protein, 608 aa, Artificial Sequence
  HIV M pol Epigraph2 Conserved
PQITLWQRPLVSIKVGGQIKEALLDTGADDTVLEEMNLPGRWKPKMIGGIGGFIKVRQYDQIPIEICGHKAIGTVLIGPTPVNIIGRNMLTQLGCTLNFPISPIDTVPVTLKPGMDGPRVKQWPLTEEKIKALTEICKEMEKEGKITKIGPENPYNTPIFAIKKKDSTKWRKLVDFRELNKKTQDFWEVQLGIPHPAGLKKKKSVTVLDVGDAYFSVPLDESFRKYTAFTIPSTNNETPGIRYQYNVLPQGWKGSPAIFQCSMTKILEPFRIKNPEIVIYQYMDDLYVGSDLEIGQHRAKIEELREHLLRWGFTTPDKKHQKEPPFLWMGYELHPDRWTVQPIELPEKDSWTVNDIQKLVGKLNWASQIYHGQVDCSPGMWQLDCTHLEGKIILVAVHVASGYMEAEVIPAETGQETAYFILKLAGRWPVKTIHTDNGSNFTSTTVKAACWWAGIQQEFGIPYNPQSQGVVESMNNELKKIIGQVREQAEHLKTAVQMAVFIHNFKRRGGIGGYSAGERIVDIIATDIQTRELQKQIIKIQNFRVYYRDSRDPLWKGPAKLLWKGEGAVVIQDNSEIKVVPRRKVKIIKDYGKQMAGDDCVASRQDED

SEQ ID NO: 730 - protein, 500 aa, Artificial Sequence
  HIV B gag Epigraph1
MGARASVLSGGELDRWEKIRLRPGGKKKYRLKHIVWASRELERFAVNPGLLETSEGCRQILGQLQPSLQTGSEELKSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLKSLFGNDPSSQ

SEQ ID NO: 731 - protein, 231 aa, Artificial Sequence
  HIV B gag Epigraph1 Conserved
PIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVL

SEQ ID NO: 732 - protein, 499 aa, Artificial Sequence
  HIV B gag Epigraph2
MGARASVLSGGKLDKWEKIRLRPGGKKKYKLKHIVWASRELERFALNPGLLETSEGCKQILGQLQPALQTGSEELRSLYNTVAVLYCVHQRIDVKDTKEALEKIEEEQNKSKKRAQQAAADTGNNSQVSQNYPIVQNMQGQMVHQPISPRTLNAWVKVIEEKAFSPEVIPMFTALSEGATPQDLNTMLNTVGGHQAAMQILKETINEEAADWDRLHPVHAGPVAPGQMREPRGSDIAGTTSNLQEQIGWMTSNPPIPVGEIYKRWIIMGLNKIVRMYSPVSILDIKQGPKEPFRDYVDRFYKVLRAEQASQDVKNWMTETLLVQNSNPDCKTILKALGPGATLEEMMTACQGVGGPSHKARILAEAMSQVTNSATIMMQKGNFRNQRKIVKCFNCGKEGHIARNCRAPRKKGCWKCGREGHQMKDCNERQANFLGKIWPSYKGRPGNFLQNRPEPTAPPAESFRFGEETTTPPQKQEPIDKDLYPLASLRSLFGNDPSS

SEQ ID NO: 733 - protein, 231 aa, Artificial Sequence
  HIV B gag Epigraph2 Conserved
PIVQNMQGQMVHQPISPRTLNAWVKVIEEKAFSPEVIPMFTALSEGATPQDLNTMLNTVGGHQAAMQILKETINEEAADWDRLHPVHAGPVAPGQMREPRGSDIAGTTSNLQEQIGWMTSNPPIPVGEIYKRWIIMGLNKIVRMYSPVSILDIKQGPKEPFRDYVDRFYKVLRAEQASQDVKNWMTETLLVQNSNPDCKTILKALGPGATLEEMMTACQGVGGPSHKARIL

SEQ ID NO: 734 - protein, 206 aa, Artificial Sequence
  HIV B nef Epigraph1
MGGKWSKSSIVGWPAVRERMRRAEPAAEGVGAVSRDLEKHGAITSSNTAATNADCAWLEAQEEEEVGFPVRPQVPLRPMTYKGALDLSHFLKEKGGLEGLIYSQKRQDILDLWVYHTQGYFPDWQNYTPGPGIRYPLTFGWCFKLVPVEPEKVEEANEGENNSLLHPMSQHGMDDPEKEVLMWKFDSRLAFHHMARELHPEYYKDC

SEQ ID NO: 735 - protein, 81 aa, Artificial Sequence
  HIV B nef Epigraph1 Conserved
GFPVRPQVPLRPMTYKGALDLSHFLKEKGGLEGLIYSQKRQDILDLWVYHTQGYFPDWQNYTPGPGIRYPLTFGWCFKLVP

SEQ ID NO: 736 - protein, 206 aa, Artificial Sequence
  HIV B nef Epigraph2
MGGKWSKSSVVGWPAIRERMRRAEPAADGVGAASRDLERHGAITSSNTAANNAACAWLEAQEDEEVGFPVKPQVPLRPMTYKAAVDLSHFLKEKGGLEGLIHSQKRQEILDLWVYHTQGFFPDWQNYTPGPGTRFPLTFGWCFKLVPVDPDKVEEANEGENNCLLHPMSLHGMDDPEREVLVWKFDSRLAFHHVARELHPEYYKNC

SEQ ID NO: 737 - protein, 81 aa, Artificial Sequence
  HIV B nef Epigraph2 Conserved
GFPVKPQVPLRPMTYKAAVDLSHFLKEKGGLEGLIHSQKRQEILDLWVYHTQGFFPDWQNYTPGPGTRFPLTFGWCFKLVP

SEQ ID NO: 738 - protein, 1003 aa, Artificial Sequence; identical to SEQ ID NO: 717
  HIV B pol Epigraph1

SEQ ID NO: 739 - protein, 608 aa, Artificial Sequence
  HIV B pol Epigraph1 Conserved
PQITLWQRPLVTIKIGGQLKEALLDTGADDTVLEEMNLPGRWKPKMIGGIGGFIKVRQYDQIPIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 740 - protein, 1003 aa, Artificial Sequence
  HIV B pol Epigraph2
FFREDLAFPQGEAREFPSEQTRANSPTRGELQVWGGDNNSPSEAGADRQGTVSLSFPQITLWQRPLVTIKVGGQLKEALLDTGADDTVLEDMNLPGKWKPKMIGGIGGFIKVRQYDQILIEICGHKAIGTVLIGPTPVNIIGRNLLTQLGCTLNFPISPIDTVPVKLKPGMDGPRVKQWPLTEEKIKALIEICTEMEKEGKISRIGPENPYNTPIFAIKKKDSTKWRKLVDFRELNKKTQDFWEVQLGIPHPSGLKKKKSVTVLDVGDAYFSVPLDKEFRKYTAFTIPSTNNETPGIRYQYNVLPQGWKGSPAIFQCSMTKILEPFRKQNPEIVIYQYMDDLYVGSDLEIEQHRTKIEELRQHLLKWGFTTPDKKHQKEPPFLWMGYELHPDKWTVQPIMLPEKDSWTVNDIQKLVGKLNWASQIYPGIKVRQLCKLLRGAKALTEVIPLTEEAELELAENREILREPVHGVYYDPTKDLIAEIQKQGLGQWTYQIYQEPYKNLKTGKYARTRGAHTNDVRQLTEAVQKITTESIVIWGKTPKFRLPIQKETWETWWTEYWQATWIPEWEFVNTPPLVKLWYQLEKEPIIGAETFYVDGAANRDTKLGKAGYVTNKGRQKVVTLTDTTNQKTELQAIYLALQDSGSEVNIVTDSQYALGIIQAQPDKSESELVNQIIEQLIKKEKIYLAWVPAHKGIGGNEQVDKLVSSGIRKVLFLDGIDKAQEDHEKYHSNWKAMASDFNLPPIVAKEIVASCDKCQLKGEAIHGQVDCSPGIWQLDCTHLEGKVILVAVHVASGYIEAEVIPAETGQETAYFILKLAGRWPVKTVHTDNGSNFTSATVKAACWWAGVKQEFGIPYNPQSQGVVESMNNELKKIIGQIRDQAEHLKTAVQMAVFIHNFKRKGGIGGYSAGERIIDIIATDIQTRELQKQITKIQNFRVYYRDNRDPLWKGPAKLLWKGEGAVVIQDNSEIKVVPRRKVKIIRDYGKQMAGDDCVAGRQDED

SEQ ID NO: 741 - protein, 608 aa, Artificial Sequence
  HIV B pol Epigraph2 Conserved
PQITLWQRPLVTIKVGGQLKEALLDTGADDTVLEDMNLPGKWKPKMIGGIGGFIKVRQYDQILIEICGHKAIGTVLIGPTPVNIIGRNLLTQLGCTLNFPISPIDTVPVKLKPGMDGPRVKQWPLTEEKIKALIEICTEMEKEGKISRIGPENPYNTPIFAIKKKDSTKWRKLVDFRELNKKTQDFWEVQLGIPHPSGLKKKKSVTVLDVGDAYFSVPLDKEFRKYTAFTIPSTNNETPGIRYQYNVLPQGWKGSPAIFQCSMTKILEPFRKQNPEIVIYQYMDDLYVGSDLEIEQHRTKIEELRQHLLKWGFTTPDKKHQKEPPFLWMGYELHPDKWTVQPIMLPEKDSWTVNDIQKLVGKLNWASQIYHGQVDCSPGIWQLDCTHLEGKVILVAVHVASGYIEAEVIPAETGQETAYFILKLAGRWPVKTVHTDNGSNFTSATVKAACWWAGVKQEFGIPYNPQSQGVVESMNNELKKIIGQIRDQAEHLKTAVQMAVFIHNFKRKGGIGGYSAGERIIDIIATDIQTRELQKQITKIQNFRVYYRDNRDPLWKGPAKLLWKGEGAVVIQDNSEIKVVPRRKVKIIRDYGKQMAGDDCVAGRQDED

SEQ ID NO: 742 - protein, 498 aa, Artificial Sequence
  HIV C gag Epigraph1
MGARASILRGGKLDKWEKIRLRPGGKKHYMLKHLVWASRELERFALNPGLLETSEGCKQIMKQLQPALQTGTEELRSLYNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPGHKARVLAEAMSQANSNIMMQRSNFKGPKRIVKCFNCGKEGHIARNCRAPRKKGCWKCGKEGHQMKDCTERQANFLGKIWPSHKGRPGNFLQSRPEPTAPPAEPTAPPAESFRFEETTPAPKQEPKDREPLTSLKSLFGSDPLSQ

SEQ ID NO: 743 - protein, 231 aa, Artificial Sequence
  HIV C gag Epigraph1 Conserved
PIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPGHKARVL

SEQ ID NO: 744 - protein, 500 aa, Artificial Sequence
  HIV C gag Epigraph2
MGARASVLRGEKLDKWERIRLRPGGKKRYMLKHIVWASRELEKFALNPGLLETAEGCKQIIKQLHPALQTGTEELKSLFNTVATLYCVHKKIDVRDTKEALDKIEEEQNKCQQKTQQAEAADKGKVSQNYPIVQNLQGQMVHQALSPRTLNAWVKVVEEKAFSPEIIPMFTALSEGATPTDLNTMLNTVGGHQAAMQMLKDTINEEAAEWDRVHPVHAGPVAPGQMREPRGSDIAGTTSNLQEQIAWMTNNPPIPVGEIYKRWIILGLNKIVRMYSPVSILDIRQGPKEPFRDYVDRFFKVLRAEQATQEVKNWMTETLLVQNANPDCKTILRALGPGASLEEMMTACQGVGGPSHKARVLAEAMSQANNANIMMQRSNFKGSKRIVKCFNCGKEGHIAKNCRAPRKKGCWKCGREGHQMKDCNERQANFLGKIWPSNKGRPGNFLQNRPEPTAPPAEPTAPPAESFKFEETTPAPKQESKDREPLISLKSLFGNDPLSQ

SEQ ID NO: 745 - protein, 231 aa, Artificial Sequence
  HIV C gag Epigraph2 Conserved
PIVQNLQGQMVHQALSPRTLNAWVKVVEEKAFSPEIIPMFTALSEGATPTDLNTMLNTVGGHQAAMQMLKDTINEEAAEWDRVHPVHAGPVAPGQMREPRGSDIAGTTSNLQEQIAWMTNNPPIPVGEIYKRWIILGLNKIVRMYSPVSILDIRQGPKEPFRDYVDRFFKVLRAEQATQEVKNWMTETLLVQNANPDCKTILRALGPGASLEEMMTACQGVGGPSHKARVL

SEQ ID NO: 746 - protein, 207 aa, Artificial Sequence
  HIV C nef Epigraph1
MGGKWSKSSIVGWPAVRERIRRTEPAAEGVGAASQDLDKYGALTSSNTAHNNADCAWLQAQEEEEEVGFPVRPQVPLRPMTYKAAFDLSFFLKEKGGLEGLIYSKKRQEILDLWVYHTQGFFPDWQNYTPGPGVRYPLTFGWCFKLVPVDPREVEEANEGENNCLLHPMSQHGMEDEDREVLKWQFDSSLARRHMARELHPEYYKDC

SEQ ID NO: 747 - protein, 80 aa, Artificial Sequence
  HIV C nef Epigraph1 Conserved
GFPVRPQVPLRPMTYKAAFDLSFFLKEKGGLEGLIYSKKRQEILDLWVYHTQGFFPDWQNYTPGPGVRYPLTFGWCFKLV

SEQ ID NO: 748 - protein, 207 aa, Artificial Sequence
  HIV C nef Epigraph2
MGSKWSKSSIVGWPAVRERMRRAEPAAEGVGAASRDLDKHGALTSSNTPANNADCAWLEAQEEEGEVGFPVKPQVPLRPMTYKGAFDLGFFLKEKGGLDGLIYSKKRQDILDLWVYNTQGYFPDWQNYTPGPGIRYPLTFGWCYKLVPVDPSEVEEANKGENNCLLHPMSLHGMEDEHREVLKWKFDSSLARRHLAREKHPEFYKDC

SEQ ID NO: 749 - protein, 80 aa, Artificial Sequence
  HIV C nef Epigraph2 Conserved
GFPVKPQVPLRPMTYKGAFDLGFFLKEKGGLDGLIYSKKRQDILDLWVYNTQGYFPDWQNYTPGPGIRYPLTFGWCYKLV

SEQ ID NO: 750 - protein, 1007 aa, Artificial Sequence
  HIV C pol Epigraph1
FFRENLAFPQGEAREFPSEQTRANSPTSRANSPTSRELQVRGDNPRSEAGAERQGTLNFPQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAMESIVIWGKTPKFRLPIQKETWETWWTDYWQATWIPEWEFVNTPPLVKLWYQLEKEPIAGAETFYVDGAANRETKIGKAGYVTDRGRQKIVSLTETTNQKTELQAIQLALQDSGSEVNIVTDSQYALGIIQAQPDKSESELVNQIIEQLIKKERVYLSWVPAHKGIGGNEQVDKLVSSGIRKVLFLDGIDKAQEEHEKYHSNWRAMASEFNLPPIVAKEIVASCDKCQLKGEAIHGQVDCSPGIWQLDCTHLEGKIILVAVHVASGYIEAEVIPAETGQETAYYILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKVKIIKDYGKQMAGADCVAGRQDEDQ

SEQ ID NO: 751 - protein, 609 aa, Artificial Sequence
  HIV C pol Epigraph1 Conserved
PQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYHGQVDCSPGIWQLDCTHLEGKIILVAVHVASGYIEAEVIPAETGQETAYYILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKVKIIKDYGKQMAGADCVAGRQDEDQ

SEQ ID NO: 752 - protein, 1006 aa, Artificial Sequence
  HIV C pol Epigraph2
FFRENLAFQQGEAREFPSEQARANSPTSRANSPTSRELQVRGDNPCSEAGAERQGTFNFPQITLWQRPLVTIKVGGQIKEALLDTGADDTVLEDINLPGKWKPRMIGGIGGFIKVRQYDQIPIEICGKKAIGSVLVGPTPVNIIGRNLLTQLGCTLNFPISPIETIPVKLKPGMDGPRVKQWPLTEEKIKALTEICEEMEKEGKISKIGPENPYNTPIFAIKKKDSTKWRKLVDFRELNKRTQDFWEVQLGIPHPAGLKKKKSVTVLDVGDAYFSVPLDESFRKYTAFTIPSTNNETPGIRYQYNVLPQGWKGSPAIFQSSMTRILEPFRAKNPEIVIYQYMDDLYVGSDLEIEQHRAKIEELREHLLRWGFTTPDKKHQKEPPFLWMGYELHPDKWTVQPIQLPEKESWTVNDIQKLVGKLNWASQIYPGIKVKQLCKLLRGTKALTDIVPLTEEAELELAENREILREPVHGVYYDPSKELIAEIQKQGQDQWTYQIYQEPFKNLKTGKYAKRRTAHTNDVRQLTEAVQKIALESIVIWGKIPKFRLPIQKETWEIWWTDYWQATWIPDWEFVNTPPLVKLWYQLEKEPIAGVETFYVDGAANRETKLGKAGYVTDKGRQKIVTLTETTNQKAELQAIQLALQDSGPEVNIVTDSQYALGIIQAQPDKSESEIVNQIIEQLINKERIYLSWVPAHKGIGGNEQVDKLVSNGIRKVLFLDGIDKAQEEHEKYHNNWRAMASDFNLPPVVAKEIVASCDQCQLKGEAMHGQVDCSPGIWQLDCTHLEGKVILVAVHVASGYMEAEVIPAETGQETAYFILKLAGRWPVKIIHTDNGSNFTSTAVKAACWWAGIKQEFGIPYNPQSQGVVESMNKELKKIIGQVREQAEHLKTAVQMAVFIHNFKRRGGIGGYSAGERIIDIIASDIQTKELQKQITKIQNFRVYYRDSRDPIWKGPAKLLWKGEGAVVLQDNSDIKVVPRRKAKIIRDYGKQMAGDDCVAGRQDED

SEQ ID NO: 753 - protein, 607 aa, Artificial Sequence
  HIV C pol Epigraph2 Conserved
PQITLWQRPLVTIKVGGQIKEALLDTGADDTVLEDINLPGKWKPRMIGGIGGFIKVRQYDQIPIEICGKKAIGSVLVGPTPVNIIGRNLLTQLGCTLNFPISPIETIPVKLKPGMDGPRVKQWPLTEEKIKALTEICEEMEKEGKISKIGPENPYNTPIFAIKKKDSTKWRKLVDFRELNKRTQDFWEVQLGIPHPAGLKKKKSVTVLDVGDAYFSVPLDESFRKYTAFTIPSTNNETPGIRYQYNVLPQGWKGSPAIFQSSMTRILEPFRAKNPEIVIYQYMDDLYVGSDLEIEQHRAKIEELREHLLRWGFTTPDKKHQKEPPFLWMGYELHPDKWTVQPIQLPEKESWTVNDIQKLVGKLNWASQIYHGQVDCSPGIWQLDCTHLEGKVILVAVHVASGYMEAEVIPAETGQETAYFILKLAGRWPVKIIHTDNGSNFTSTAVKAACWWAGIKQEFGIPYNPQSQGVVESMNKELKKIIGQVREQAEHLKTAVQMAVFIHNFKRRGGIGGYSAGERIIDIIASDIQTKELQKQITKIQNFRVYYRDSRDPIWKGPAKLLWKGEGAVVLQDNSDIKVVPRRKAKIIRDYGKQMAGDDCVAGRQDE

SEQ ID NO: 754 - protein, 520 aa, Artificial Sequence
  HIV M Gag episensus EG-0, Tailored
MGARASVLSGGKLDAWEKIRLRPGGKKKYRLKHLVWASRELERFALNPGLLETSEGCRQILGQLQPSLQTGSEELKSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPVSILDIRQGPKEPFRDYVDRFYKTLRAEQATQEVKNWMTETLLVQNANPDCKTILKALGPAATLEEMMTACQGVGGPGHKARVLAEAMSQVTNSATIMMQRGNFKGQKRIKCFNCGKEGHIARNCRAPRKKGCWKCGKEGHQMKDCTERQANFLGKIWPSHKGRPGNFLQSRPEPTAQSRPEPTAPPAESFRPQPTAPPEESFRFGEETTTPSQKQEPIDKELYPLASLKSLFGNDPLSQY

SEQ ID NO: 755 - protein, 231 aa, Artificial Sequence; identical to SEQ ID NO: 719
  HIV M gag episensus EG-0 Conserved, Tailored

SEQ ID NO: 756 - protein, 532 aa, Artificial Sequence
  HIV M gag CEN-1, Tailored
MGARASVLTGGKLDAWERIRLRPGGKKKYRMKHLVWASRELERFAINPGLLETAEGCQQIIEQLQSTLKTGSEELKSLFNTVATLWCVHQRIEIKDTKEALDKLEEVQNKSQQKTQQAAAGTGSSSKVSQNYPIVQNAQGQMVHQPLSPRTLNAWVKVVEEKGFNPEVIPMFSALSDGATPQDLNMMLNIVGGHQAAMQMLKDTINEEAAEWDRVHPVHAGPIPPGQMREPRESDIAGTTSNLQEQIGWMTSNPPIPVGDIYKRWIILGLHKIVRMYSPVGILDIKQGPKEPFRDYVDRFFKTLRAEQASQEVKNWMTETLLIQNANPDCKSILKALGTGATLEEMMTACQGVGGPSHKARVLAEAMSQAQHANIMMQRGNFKGQRKIKCFNCGKEGHLARNCRAPRKRGCWKCGQEGHQMKDCNERQANFLGKIWPSNKGRPGNFPQSRPEPTAPRTEPTAPPARPEPTAPPLQSRLEPTAPPAEPTAPPAENWGMGEEITSLLKQEQKDKEHPPPLVSLKSLFGNDPLLQ

SEQ ID NO: 757 - protein, 231 aa, Artificial Sequence
  HIV M gag CEN-1 Conserved, Tailored
PIVQNAQGQMVHQPLSPRTLNAWVKVVEEKGFNPEVIPMFSALSDGATPQDLNMMLNIVGGHQAAMQMLKDTINEEAAEWDRVHPVHAGPIPPGQMREPRESDIAGTTSNLQEQIGWMTSNPPIPVGDIYKRWIILGLHKIVRMYSPVGILDIKQGPKEPFRDYVDRFFKTLRAEQASQEVKNWMTETLLIQNANPDCKSILKALGTGATLEEMMTACQGVGGPSHKARVL

SEQ ID NO: 758 - protein, 536 aa, Artificial Sequence
  HIV M gag CEN-2, Tailored
MGARASILRGGKLDKWEKIRLRPGGKKHYMLKHIVWASRELEKFALNPDLLETSEGCKQIIKQLQPALQTGTEELRSLFNTVATLYCVHEKIEVRDTKEALDKVEEEQNKSQQKTQQAKAADGKVSQNYPIVQNAQGQMVHQALSPRTLNAWVKVIEEKAFSPEVIPMFTALSEGATPSDLNTMLNTIGGHQAAMQMLKDTINEEAAEWDRVHPVHAGPVAPGQMREPRGSDIAGSTSTLQEQIAWMTSNPPIPVGDIYKRWIILGLNKIVKMYSPVSILDIKQGPKEPFRDYVDRFFKTLRAEQATQDVKNWMTDTLLVQNANPDCKTILRALGPGATLEEMMTACQGVGGPSHKARVLAEAMSQANSNIMMQRSNFKGPKRIVKCFNCGKEGHIAKNCRAPRKKGCWKCGREGHQMKDCNERQANFLGKIWPSNKGRPGNFLQNRPEPTAPPLQSRLEPTAPLEPTAPPEPTAPPAVVPTAPPVEPTAPPAEPTAPPAESFRFEETTPAPKQEPKDREPLTSLKSLFGSDPLSQ

SEQ ID NO: 759 - protein, 231 aa, Artificial Sequence
  HIV M gag CEN-2 Conserved, Tailored
PIVQNAQGQMVHQALSPRTLNAWVKVIEEKAFSPEVIPMFTALSEGATPSDLNTMLNTIGGHQAAMQMLKDTINEEAAEWDRVHPVHAGPVAPGQMREPRGSDIAGSTSTLQEQIAWMTSNPPIPVGDIYKRWIILGLNKIVKMYSPVSILDIKQGPKEPFRDYVDRFFKTLRAEQATQDVKNWMTDTLLVQNANPDCKTILRALGPGATLEEMMTACQGVGGPSHKARVL

SEQ ID NO: 760 - protein, 520 aa, Artificial Sequence
  HIV M gag CEN-3, Tailored
MGSRASVLSGGELDRWEKIRLRPGGKKKYKLKHIVWASRELERFAVNPGLLETSEGCKQILGQLQPALQTGSEELRSLYNTVAVLYCVHQRIDVKDTKEALEKIEEEQNKCKKKAQQAAAAADTGNNSQVSQNYPIVQNIQGQMVHQALSPRTLNAWVKVIEEKAFSPEVIPMFTALSEGATPSDLNTMLNTIGGHQAAMQMLKDTINEEAADWDRLHPVQAGPVAPGQMRDPRGSDIAGTTSNLQEQIGWMTSNPPIPVGDIYKRWIIMGLNKIVRMYSPTSILDIKQGPKEPFRDYVDRFFKTLRAEQASQEVKNWMTETLLVQNSNPDCKTILKALGPGATLEEMMTACQGVGGPSHKARVLAEAMSQATNSAAIMMQRGNFRNQRKIVKCFNCGKEGHIAKNCRAPRKRGCWKCGREGHQMKDCNERQANFLGRIWPSNKGRPGNFLQNRPEPTAPNFLQSRPEPSAPPEPTAPPEESFRFGEETATPSQKQEPTDKELYPLASLRSLFGNDPSSQ

SEQ ID NO: 761 - protein, 231 aa, Artificial Sequence
  HIV M gag CEN-3 Conserved, Tailored
PIVQNIQGQMVHQALSPRTLNAWVKVIEEKAFSPEVIPMFTALSEGATPSDLNTMLNTIGGHQAAMQMLKDTINEEAADWDRLHPVQAGPVAPGQMRDPRGSDIAGTTSNLQEQIGWMTSNPPIPVGDIYKRWIIMGLNKIVRMYSPTSILDIKQGPKEPFRDYVDRFFKTLRAEQASQEVKNWMTETLLVQNSNPDCKTILKALGPGATLEEMMTACQGVGGPSHKARVL

SEQ ID NO: 762 - protein, 506 aa, Artificial Sequence
  HIV M gag CEN-4, Tailored
MGTRASVLSGGELDRWEKIRLRPGGKKKYKLKHIVWASRELERFAVNPGLLETAEGCRQILEQLQPALQTGSEELRSLYNTVAVLYCVHQRIDVKDTKEALEKIEEEQNKCKKKAQQTAADTGNNSQVSQNYPIVQNMQGQMVHQPISPRTLNAWVKVIEEKAFSPEVIPMFTALSEGATPHDLNTMLNTIGGHQAAMQMLKDTINEEAAEWDRVHPVHAGPVAPGQMREPKGSDIAGTTSNLQEQIGWMTHNPPIPVGDIYKRWIIMGLNKIVRMYSPTSILDIKQGPKEPFRDYVDRFFKTLRAEQASQDVKNWMTETLLVQNSNPDCKTILKALGPGATLEEMMSACQGVGGPSHKARILAEAMSQATNSANIMMQRGNFRNQRKTVKCFNCGKEGHIAKNCRAPRKRGCWKCGREGHQMKDCNERQANFLGKIWPSYKGRPGNFLQNRPEPTAPPEPTAPPEESFGFGEETTTPPQKQEPIDKDLYPLASLRSLFGNDPSSQ

SEQ ID NO: 763 - protein, 231 aa, Artificial Sequence
  HIV M gag CEN-4 Conserved, Tailored
PIVQNMQGQMVHQPISPRTLNAWVKVIEEKAFSPEVIPMFTALSEGATPHDLNTMLNTIGGHQAAMQMLKDTINEEAAEWDRVHPVHAGPVAPGQMREPKGSDIAGTTSNLQEQIGWMTHNPPIPVGDIYKRWIIMGLNKIVRMYSPTSILDIKQGPKEPFRDYVDRFFKTLRAEQASQDVKNWMTETLLVQNSNPDCKTILKALGPGATLEEMMSACQGVGGPSHKARIL

SEQ ID NO: 764 - protein, 514 aa, Artificial Sequence
  HIV M gag CEN-5, Tailored
MGARASILSGGKLDAWERIRLRPGGKKKYRMKHLVWASRELDRFALNPSLLETAEGCQQIMEQLQPALKTGTEELRSLFNTVATLYCVHQRIDVKDTKEALDKIEEIQNKSKQKTQQAAADTGNSSKVSQNYPIVQNAQGQMIHQSLSPRTLNAWVKVIEEKAFSPEVIPMFTALSEGATPQDLNMMLNIVGGHQAAMQMLKDTINEEAAEWDRVHPVHAGPIPPGQMREPRGGDIAGTTSTPQEQIGWMTSNPPIPVGDIYKRWIILGLHKLVRMYSPVSILDIKQGPKEPFRDYVDRFFKTLRAEQATQEVKGWMTETLLIQNANPDCKSILRALGPGATLEEMMTACQGVGGPSHKARVLAEAMSQVQHTNIMMQRGNFRGQKRIKCFNCGKEGHLARNCRAPRKRGCWKCGREGHQMKDCNERQANFLGKIWPSSKGRPGNFPQSRPEPTAPQNRLEPTAPPAEPTAPPAEIFGMGEEITSPPKQEQKDREQAPPLVSLKSLFGNDLLSQ

SEQ ID NO: 765 - protein, 231 aa, Artificial Sequence
  HIV M gag CEN-5 Conserved, Tailored
PIVQNAQGQMIHQSLSPRTLNAWVKVIEEKAFSPEVIPMFTALSEGATPQDLNMMLNIVGGHQAAMQMLKDTINEEAAEWDRVHPVHAGPIPPGQMREPRGGDIAGTTSTPQEQIGWMTSNPPIPVGDIYKRWIILGLHKLVRMYSPVSILDIKQGPKEPFRDYVDRFFKTLRAEQATQEVKGWMTETLLIQNANPDCKSILRALGPGATLEEMMTACQGVGGPSHKARVL

SEQ ID NO: 766 - protein, 498 aa, Artificial Sequence
  HIV C gag episensus EG-0, Tailored
MGARASILRGGKLDKWEKIRLRPGGKKHYMLKHLVWASRELERFALNPGLLETSEGCKQIMKQLQPALQTGTEELRSLYNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPVAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPGHKARVLAEAMSQANSNIMMQRSNFKGPKRIVKCFNCGKEGHIARNCRAPRKKGCWKCGKEGHQMKDCTERQANFLGKIWPSHKGRPGNFLQSRPEPTAPPAEPTAPPAESFRFEETTPAPKQEPKDREPLTSLKSLFGSDPLSQ

SEQ ID NO: 767 - protein, 231 aa, Artificial Sequence
  HIV C gag episensus EG-0 Conserved, Tailored
PIVQNLQGQMVHQAISPRTLNAWVKVIEEKAFSPEVIPMFTALSEGATPQDLNTMLNTVGGHQAAMQMLKDTINEEAAEWDRLHPVHAGPVAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPGHKARVL

SEQ ID NO: 768 - protein, 509 aa, Artificial Sequence
  HIV C gag CEN-1, Tailored
MGARASILRGEKLDKWEKIKLRPGGKKRYMLKHLIWASRELERFALNPSLLETSEGCKQIIKQLQPALKTGTEELRSLFNTVATLYCVHAGIEVRDTKEALDRIEEEQNKCQQKTQQAEAADKGKVSQNYPIVQNAQGQMVHQALSPRTLNAWVKVVEEKAFSPEIIPMFTALSEGATPSDLNSMLNTVGGHQAAMQMLKDTINDEAAEWDRVHPVHAGPIAPGQMREPRGSDIAGTTSNLQEQIAWMTNNPPIPVGEIYKRWIILGLNKIVRMYSPVSILDIRQGPKEPFRDYVDRFFKCLRAEQATQEVKNWMTDTLLIQNANPDCKTILKALGPGASLEEMMTACQGVGGPSHKARVLAEAMSQVNNANIMMQRGNFKGPKRIIKCFNCGKEGHLARNCRAPRKKGCWKCGQEGHQMKDCSNERQANFLGKLWPSHKGGRPGNFLQNRPEPTAPPVEPTAPPAEPTAPPAESFKFEETTPVPKQELKDREPLISLKSLFGNDPLSQ

SEQ ID NO: 769 - protein, 230 aa, Artificial Sequence
  HIV C gag CEN-1 Conserved, Tailored
IVQNAQGQMVHQALSPRTLNAWVKVVEEKAFSPEIIPMFTALSEGATPSDLNSMLNTVGGHQAAMQMLKDTINDEAAEWDRVHPVHAGPIAPGQMREPRGSDIAGTTSNLQEQIAWMTNNPPIPVGEIYKRWIILGLNKIVRMYSPVSILDIRQGPKEPFRDYVDRFFKCLRAEQATQEVKNWMTDTLLIQNANPDCKTILKALGPGASLEEMMTACQGVGGPSHKARVL

SEQ ID NO: 770 - protein, 515 aa, Artificial Sequence
  HIV C gag CEN-2, Tailored
MGARASILRGEKLDKWERIRLRPGGKKHYMIKHLVWASRELEKFALNPGLLETADGCKQIIKQLHPALQTGTEELKSLYNTVATLYCVHERIEVRDTKEALDRIEEEQNKCQQKTQQAEAADKGKVSQNYPIVQNAQGQMVHQPISPRTLNAWVKVVEEKAFSPEIIPMFTALSEGATPTDLNTMLNTIGGHQAAMQILKDTINEEAVEWDRLHPVQAGPVAPGQIREPRGSDIAGTTSNLQEQIAWMTGNPPVPVGDIYKRWIIMGLNKIVRMYSPVSILDIRQGPKEPFRDYVDRFFKVLRAEQATQEVKNWMTETLLVQNANPDCKIILKGLGPAATLEEMMTACQGVGGPSHKARVLAEAMSQVNNTNIMMQKSNFKGPKRTVKCFNCGKEGHIAKNCRAPRKKGCWKCGREGHQMKDCNERQANFLGKIWPSQKGRPGNFLQNRPEPTAPRPEPTAPPRLEPTAPPAEPSAPPAESFRFEGTTPAPKQESKDREPLISLKSLFGNDPLSQ

SEQ ID NO: 771 - protein, 231 aa, Artificial Sequence
  HIV C gag CEN-2 Conserved, Tailored
PIVQNAQGQMVHQPISPRTLNAWVKVVEEKAFSPEIIPMFTALSEGATPTDLNTMLNTIGGHQAAMQILKDTINEEAVEWDRLHPVQAGPVAPGQIREPRGSDIAGTTSNLQEQIAWMTGNPPVPVGDIYKRWIIMGLNKIVRMYSPVSILDIRQGPKEPFRDYVDRFFKVLRAEQATQEVKNWMTETLLVQNANPDCKIILKGLGPAATLEEMMTACQGVGGPSHKARVL

SEQ ID NO: 772 - protein, 523 aa, Artificial Sequence
  HIV C gag CEN-3, Tailored
MGARASILRGEKLDRWERIRLRPGGKKCYMLKHIVWASRELERFSLNPGLLETAEGCKQIIKQLHPALQTGTEELKSLFNTVATLYCVHKKIDVRDTKEALDKVEEEQNKCQQKTQQAKAADEKVSQNYPIVQNIQGQMVHQALSPRTLNAWVKVVEEKAFSPEIIPMFTALSEEATPQDLNTMLNAVGGHQAAMQMLKETINEEAAEWDRVHPVHAGPIAPGQMREPRGSDIAGTTSNLQEQIAWMTNNPPIPVGEIYKRWIILGLNKIVRMYSPVSILDIRQGPKEPFRDYVDRFFRVLRAEQATQEVKNWMTDTLLIQNANPDCKTILKALGPGASLEEMMTACQGVGGPSHKARVLAEAMSQANNINIMMQRGNFKGPKRTVKCFNCGKEGHIAKNCRAPRKRGCWKCGKEGHQMKDCNERQANFLGRIWPSHKGRPGNFLQNRPEPTAPSAESFRQNRTEPTAPPARLEPTAPPAEPSAPPVESFRFEETTPALKQESKDREPLTSLRSLFGSDPLFQ

SEQ ID NO: 773 - protein, 231 aa, Artificial Sequence
  HIV C gag CEN-3 Conserved, Tailored
PIVQNIQGQMVHQALSPRTLNAWVKVVEEKAFSPEIIPMFTALSEEATPQDLNTMLNAVGGHQAAMQMLKETINEEAAEWDRVHPVHAGPIAPGQMREPRGSDIAGTTSNLQEQIAWMTNNPPIPVGEIYKRWIILGLNKIVRMYSPVSILDIRQGPKEPFRDYVDRFFRVLRAEQATQEVKNWMTDTLLIQNANPDCKTILKALGPGASLEEMMTACQGVGGPSHKARVL

SEQ ID NO: 774 - protein, 513 aa, Artificial Sequence
  HIV C gag CEN-4, Tailored
MGARASVLRGEKLDKWERIRLRPGGKKQYMLKHIVWASRELEKFALNPGLLETAEGCKQIIKQLHPALQTGTEELRSLFNTVATLYCVHKGIDVRDTKEALDKVEEEQNKCQQKTQQAEADKKVSQNYPIVQNIQGQMVHQPLSPRTLNAWVKVVEEKAFSPEVIPMFSALSEGATPGDLNTMLNTIGGHQAAMQMLKDTINDEAAEWDRLHPVHAGPIAPGQMREPRGSDIAGTTSNLQEQIAWMTNNPPVPVGEIYKRWIVLGLNKIVRMYSPVSILDIRQGPKEPFRDYVDRFFRTLRAEQATQEVKNWMTETLLVQNANPDCKNILRALGPGASLEEMMTACQGVGGPSHKARVLAEAMSQANNTNIMMQKSNFKGPRRIVKCFNCGKEGHIAKNCRAPRKRGCWKCGKEGHQMKDCNERQANFLGKIWPSNKGRPGNFLQNRPEPTAPQSRPEPTAPLEPTAPPAEPTAPPAESFKFEETTPAPKQEQKDREPLISLKSLFGNDPLSQ

SEQ ID NO: 775 - protein, 231 aa, Artificial Sequence
  HIV C gag CEN-4 Conserved, Tailored
PIVQNIQGQMVHQPLSPRTLNAWVKVVEEKAFSPEVIPMFSALSEGATPGDLNTMLNTIGGHQAAMQMLKDTINDEAAEWDRLHPVHAGPIAPGQMREPRGSDIAGTTSNLQEQIAWMTNNPPVPVGEIYKRWIVLGLNKIVRMYSPVSILDIRQGPKEPFRDYVDRFFRTLRAEQATQEVKNWMTETLLVQNANPDCKNILRALGPGASLEEMMTACQGVGGPSHKARVL

SEQ ID NO: 776 - protein, 507 aa, Artificial Sequence
  HIV C gag CEN-5, Tailored
MGARASVLRGEKLDKWERIRLRPGGKKRYMLKHIVWASRELEKFALNPGLLETAEGCKQIIKQLQPALQTGTEELKSLFNTVATLYCVHEKIDVRDTKEALDRIEEEQNKCQQKTQQAKAADEKVSQNYPIVQNAQGQMVHQALSPRTLNAWVKVIEEKGFNPEVIPMFTALSDGATPQDLNSMLNTVGGHQAAMQILKDTINEEAAEWDRVHPVHAGPIAPGQMREPRGSDIAGTTSNLQEQIAWMTGNPPIPVGEIYKRWIILGLNKIVRMYSPVSILDIRQGPKEPFRDYVDRFFKALRAEQATQEVKNWMTETLLVQNANPDCKNILRALGPGASLEEMMTACQGVGGPSHKARVLAEAMSQANNTNIMMQRNNFKGPKRIIKCFNCGKEGHIAKNCRAPRKKGCWKCGREGHQMKDCNERQANFLGRIWPSHKGGRPGNFLQNRPEPTAPPVEPTAPPAEPTAPPAESFKFEETTPTPKQEQKDREPLISLKSLFGNDPLSQ

SEQ ID NO: 777 - protein, 231 aa, Artificial Sequence
  HIV C gag CEN-5 Conserved, Tailored
PIVQNAQGQMVHQALSPRTLNAWVKVIEEKGFNPEVIPMFTALSDGATPQDLNSMLNTVGGHQAAMQILKDTINEEAAEWDRVHPVHAGPIAPGQMREPRGSDIAGTTSNLQEQIAWMTGNPPIPVGEIYKRWIILGLNKIVRMYSPVSILDIRQGPKEPFRDYVDRFFKALRAEQATQEVKNWMTETLLVQNANPDCKNILRALGPGASLEEMMTACQGVGGPSHKARVL

SEQ ID NO: 778 - protein, 506 aa, Artificial Sequence
  HIV B gag episensus EG-0, Tailored
MGARASVLSGGELDRWEKIRLRPGGKKKYKLKHIVWASRELERFAVNPGLLETSEGCRQILGQLQPSLQTGSEELKSLYNTVATLYCVHQKIDVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIARNCRAPRKKGCWKCGKEGHQMKDCTERQANFLGKIWPSHKGRPGNFLQSRPEPTAPPEPTAPPEESFRFGEETTTPSQKQEPIDKELYPLASLKSLFGNDPSSQ

SEQ ID NO: 779 - protein, 231 aa, Artificial Sequence; identical to SEQ ID NO: 731
  HIV B gag episensus EG-0 Conserved, Tailored

SEQ ID NO: 780 - protein, 509 aa, Artificial Sequence
  HIV B gag CEN-1, Tailored
MGSRASVLSGGKLDQWEKIRLRPGGKKRYKLKHLVWASRELERFAVNPSLLETSEGCKQILGQLQPALQTGSEELRSLYNTIAVLYCVHQRIEVKDTKEALEKIEEEQNKCKKKAQQAAAAAADTGNSNQVSQNYPIVQNMQGQMVHQALSPRTLNAWVKVIEEKAFSPEVIPMFTALSEGATPADLNTMLNTIGGHQAAMQILKETINEEAAEWDRVHPVHAGPVAPGQMREPRGSDIAGSTSTLQEQIAWMTSNPPIPVGDIYKRWIIMGLNKIVRMYSPTSILDIKQGPKEPFRDYVDRFYKTLRAEQATQEVKNWMTETLLVQNSNPDCKTILKALGPGATLEEMMTACQGVGGPSHKARVLAEAMSQVTTPPAIMMQRGNFKNQRKIVKCFNCGKEGHLARNCRAPRKRGCWKCGREGHQMKDCSERQANFLGKIWPSYKGRPGNFLQNRPEPTAPPAEPTAPPAESFRFGEETATPPQKQEPIDKEMYPLTSLRSLFGNDPSQ

SEQ ID NO: 781 - protein, 231 aa, Artificial Sequence
  HIV B gag CEN-1 Conserved, Tailored
PIVQNMQGQMVHQALSPRTLNAWVKVIEEKAFSPEVIPMFTALSEGATPADLNTMLNTIGGHQAAMQILKETINEEAAEWDRVHPVHAGPVAPGQMREPRGSDIAGSTSTLQEQIAWMTSNPPIPVGDIYKRWIIMGLNKIVRMYSPTSILDIKQGPKEPFRDYVDRFYKTLRAEQATQEVKNWMTETLLVQNSNPDCKTILKALGPGATLEEMMTACQGVGGPSHKARVL

SEQ ID NO: 782 - protein, 513 aa, Artificial Sequence
  HIV B gag CEN-2, Tailored
MGSRASVLSGGKLDKWEKIRLRPGGKKKYRLKHLVWASRELERYALNPGLLETAEGCRQILGQLQPALQTGSEELKSLFNTVAVLYCVHQRIDVKDTKEALEKIEEEQNKSKKKTQQAAADTGNNSQVKVSQNYPIVQNIQGQMVHQALSPRTLNAWVKVIEEKAFSPEVIPMFTALSEGATPHDLNTMLNTIGGHQAAMQILKETINDEAAEWDRTHPVHAGPVAPGQMRDPRGSDIAGTTSNLQEQIGWMTHNPPIPVGDIYKRWIIMGLNKIVRMYSPVSILDIKQGPKEPFRDYVDRFYKILRAEQASQDVKNWMTETLLVQNSNPDCKTILKALGPGATLEEMMTACQGVGGPSHKARVLAEAMSQMTNSATIMMQKGNFRNQRKTIKCFNCGKEGHLARNCRAPRKRGCWKCGQEGHQMKDCNERQANFLGKIWPSSKGRPGNFLQSRPESRPEPTAPPAEPTAPPAESFRFGEETATPPQKQEPIDKEMYPLASLRSLFGNDPSSK

SEQ ID NO: 783 - protein, 231 aa, Artificial Sequence
  HIV B gag CEN-2 Conserved, Tailored
PIVQNIQGQMVHQALSPRTLNAWVKVIEEKAFSPEVIPMFTALSEGATPHDLNTMLNTIGGHQAAMQILKETINDEAAEWDRTHPVHAGPVAPGQMRDPRGSDIAGTTSNLQEQIGWMTHNPPIPVGDIYKRWIIMGLNKIVRMYSPVSILDIKQGPKEPFRDYVDRFYKILRAEQASQDVKNWMTETLLVQNSNPDCKTILKALGPGATLEEMMTACQGVGGPSHKARVL

SEQ ID NO: 784 - protein, 510 aa, Artificial Sequence
  HIV B gag CEN-3, Tailored
MGARASILSGGELDKWEKIRLRPGGKKQYKLKHIVWASRELERFALNPGLLETSGGCRQILEQLQPALQTGSEELRSLYNTVAVLYCVHQRIEVKDTKEALEKIEEEQNKCKKKAQQAAAAAADTGNNSQVSQNYPIVQNIQGQMVHQALSPRTLNAWVKVIEEKAFSPEVIPMFTALSEGATPGDLNLMLNAVGGHQAAMQMLKDTINEEAADWDRLHPVQAGPVAPGQLREPRGSDIAGTTSNLQEQIAWMTHNPPIPVGEIYKRWIIMGLNKIVRMYSPVSILDIKQGPKEPFRDYVDRFYRTLRAEQASQDVKNWMTETLLIQNANPDCRTILKALGPGATLEEMMTACQGVGGPSHKARVLAEAMSQATSSATIMMQKGNFRNQRKIVKCFNCGKEGHIAKNCRAPRKRGCWKCGREGHQMKDCSERQANFLGKIWPSYKGRPGNFLQNRPEPTAPPAEPTAPPAESFRFGEETTTPPQKQEPTDKELYPLASLRSLFGNDPLSQ

SEQ ID NO: 785 - protein, 231 aa, Artificial Sequence
  HIV B gag CEN-3 Conserved, Tailored
PIVQNIQGQMVHQALSPRTLNAWVKVIEEKAFSPEVIPMFTALSEGATPGDLNLMLNAVGGHQAAMQMLKDTINEEAADWDRLHPVQAGPVAPGQLREPRGSDIAGTTSNLQEQIAWMTHNPPIPVGEIYKRWIIMGLNKIVRMYSPVSILDIKQGPKEPFRDYVDRFYRTLRAEQASQDVKNWMTETLLIQNANPDCRTILKALGPGATLEEMMTACQGVGGPSHKARVL

SEQ ID NO: 786 - protein, 506 aa, Artificial Sequence
  HIV B gag CEN-4, Tailored
MGARASILSGGELDKWEKIRLRPGGKKKYRLKHIVWASNELERFALNPGLLETSDGCRQILGQLHPSLQTGSEELRSLYNTVAVLYCVHQRIEIKDTKEALEKIEEEQNKCKKKAQQAAAAQQAAAGTGNNSQVSQNYPIVQNMQGQMVHQALSPRTLNAWVKVIEEKAFSPEVIPMFTALSEGATPHDLNTMLNTIGGHQAAMQILKETINEEAAEWDRVHPVHAGPIAPGQIREPRGSDIAGTTSNLQEQIGWMTHNPPIPVGEIYKKWIIMGLNKIVRMYSPVSILDIKQGPKEPFRDYVDRFYKTLRAEQATQEVKNWMTETLLVQNSNPDCKTILKALGPGATLEEMMTACQGVGGPAHKARVLAEAMSQATNSAAIMMQKGNFRNQRRTVKCFNCGKEGHIAKNCRAPRKKGCWKCGQEGHQMKDCNERQANFLGRSWPSLKGRPGNFLQNRPEPSAPPEESFKFGEETTTPPQKQEPIDKDLYPLASLRSLFGNDPSST

SEQ ID NO: 787 - protein, 231 aa, Artificial Sequence
  HIV B gag CEN-4 Conserved, Tailored
PIVQNMQGQMVHQALSPRTLNAWVKVIEEKAFSPEVIPMFTALSEGATPHDLNTMLNTIGGHQAAMQILKETINEEAAEWDRVHPVHAGPIAPGQIREPRGSDIAGTTSNLQEQIGWMTHNPPIPVGEIYKKWIIMGLNKIVRMYSPVSILDIKQGPKEPFRDYVDRFYKTLRAEQATQEVKNWMTETLLVQNSNPDCKTILKALGPGATLEEMMTACQGVGGPAHKARVL

SEQ ID NO: 788 - protein, 505 aa, Artificial Sequence
  HIV B gag CEN-5, Tailored
MGSRASVLSGGKLDKWEKIRLRPGGKKKYQLKHIVWASRELERYALNPGLLETAEGCRQILEQLQPALQTGSEELRSLYNTVAVLYCVHQKIEVKDTKEALEKVEEEQNKSKKRIQQAQQAAAADTGNSSKVSQNYPIVRNLQGQMVHQPISPRTLNAWVKVIEEKAFSPEVIPMFSALAEGATPQDLNLMLNAVGGHQAAMQMLKDTINEEAAEWDRMHPVHAGPVAPGQMREPRGSDIAGTTSNLQEQIGWMTSNPPIPVGEIYKRWIIMGLNKIVRMYSPVSILDIKQGPKEPFRDYVDRFYRTLRAEQASQDVKNWMTETLLVQNSNPDCKTILKALGPGATLEEMMTACQGVGGPSHKARVLAEAMSQVTNSTAIMMQRGNFKNQRKIVKCFNCGKEGHIAKNCRAPRKRGCWKCGREGHQMKECTERQVNFLGKIWPSYKGRPGNFLQNRPEPTAPPAPPEESFRFGEGTTTPSQKQGTIDKELYPLTSLRSLFGNDPS

SEQ ID NO: 789 - protein, 231 aa, Artificial Sequence
  HIV B gag CEN-5 Conserved, Tailored
PIVRNLQGQMVHQPISPRTLNAWVKVIEEKAFSPEVIPMFSALAEGATPQDLNLMLNAVGGHQAAMQMLKDTINEEAAEWDRMHPVHAGPVAPGQMREPRGSDIAGTTSNLQEQIGWMTSNPPIPVGEIYKRWIIMGLNKIVRMYSPVSILDIKQGPKEPFRDYVDRFYRTLRAEQASQDVKNWMTETLLVQNSNPDCKTILKALGPGATLEEMMTACQGVGGPSHKARVL

SEQ ID NO: 790 - protein, 9 aa, Artificial Sequence
  Synthetic
VTSSNMNNA

SEQ ID NO: 791 - protein, 9 aa, Artificial Sequence
  Synthetic
TSSNMNNAD

SEQ ID NO: 792 - protein, 19 aa, Artificial Sequence
  Synthetic
TSSNMNNADSVWLRAQEEE

SEQ ID NO: 793 - protein, 19 aa, Artificial Sequence
  Synthetic
TSSNMNNADCVWLRAQEEE

SEQ ID NO: 794 - protein, 7 aa, Artificial Sequence
  Synthetic
ARCHSLM

SEQ ID NO: 795 - protein, 7 aa, Artificial Sequence
  Synthetic
DEFGKLM

SEQ ID NO: 796 - protein, 12 aa, Artificial Sequence
  Synthetic
EPTAPPAEPTAP

SEQ ID NO: 797 - protein, 12 aa, Artificial Sequence
  Synthetic
PTAPPAEPTAPP

SEQ ID NO: 798 - protein, 13 aa, Artificial Sequence
  Synthetic
EPTAPPAEPTAPP

SEQ ID NO: 799 - protein, 7 aa, Artificial Sequence
  Synthetic
ARCGSLM

SEQ ID NO: 800 - protein, 7 aa, Artificial Sequence
  Synthetic
ARCGSPM

SEQ ID NO: 801 - protein, 7 aa, Artificial Sequence
  Synthetic
ARYGSLM

SEQ ID NO: 802 - protein, 7 aa, Artificial Sequence
  Synthetic
AYCHSLM

SEQ ID NO: 803 - protein, 7 aa, Artificial Sequence
  Synthetic
YRCHSLM

SEQ ID NO: 804 - protein, 7 aa, Artificial Sequence
  Synthetic
DEFGSLM

SEQ ID NO: 805 - protein, 7 aa, Artificial Sequence
  Synthetic
DEFGKLM

SEQ ID NO: 806 - protein, 8 aa, Artificial Sequence
  Synthetic
ARCCDEGH

SEQ ID NO: 807 - protein, 8 aa, Artificial Sequence
  Synthetic
ARCDEFGH

SEQ ID NO: 808 - protein, 8 aa, Artificial Sequence
  Synthetic
ARCCDEGH

SEQ ID NO: 809 - protein, 8 aa, Artificial Sequence
  Synthetic
ARCDEFGH

SEQ ID NO: 810 - protein, 7 aa, Artificial Sequence
  Synthetic
DECHSLM

What is claimed is:

1. A vector comprising a human cytomegalovirus (HCMV) backbone or a rhesus cytomegalovirus (RhCMV) backbone, wherein the HCMV or RhCMV backbone comprises a nucleic acid sequence encoding a fusion antigen comprising the amino acid sequence of SEQ ID NO: 719.

2. The vector of claim 1, wherein:
   i) the HCMV or RhCMV backbone lacks the UL130-128 gene region,
   ii) the HCMV or RhCMV backbone lacks the UL82 gene encoding the tegument protein pp71, or
   iii) the HCMV or RhCMV backbone lacks the UL130-128 gene region and the UL82 gene encoding the tegument protein pp71.

3. The vector of claim 1, wherein the fusion antigen further comprises the amino acid sequence of any one of SEQ ID NO:722-725.

4. The vector of claim 1, wherein the fusion antigen further comprises the amino acid sequence of SEQ ID NO: 723.

5. The vector of claim 4, wherein the HCMV or RhCMV backbone lacks the UL130-128 gene region and the UL82 gene encoding the tegument-protein pp71.

6. The vector of claim 1, wherein the fusion antigen comprises the amino acid sequence of SEQ ID NO: 706.

7. The vector of claim 6, wherein the HCMV or RhCMV backbone lacks the UL130-128 gene region and the UL82 gene encoding the tegument-protein pp71.

8. The vector of claim 1, wherein the fusion antigen further comprises the amino acid sequence of any one of SEQ ID NO: 709-712 and 726-729.

9. The vector of claim 1, wherein the fusion antigen further comprises the amino acid sequence of SEQ ID NO: 710.

10. The vector of claim 9, wherein the HCMV or RhCMV backbone lacks the UL130-128 gene region and the UL82 gene encoding the tegument-protein pp71.

11. The vector of claim 4, wherein the fusion antigen further comprises the amino acid sequence of SEQ ID NO: 710.

12. The vector of claim 11, wherein the HCMV or RhCMV backbone lacks the UL130-128 gene region and the UL82 gene encoding the tegument-protein pp71.

13. A method of inducing an anti-HIV-1 immune response in a subject in need thereof, comprising administering to the subject an effective amount of the vector of claim 1.

14. A method of inducing an anti-HIV-1 immune response in a subject in need thereof, comprising administering to the subject an effective amount of the vector of claim 2.

15. A method of inducing an anti-HIV-1 immune response in a subject in need thereof, comprising administering to the subject an effective amount of the vector of claim 4.

16. A method of inducing an anti-HIV-1 immune response in a subject in need thereof, comprising administering to the subject an effective amount of the vector of claim 5.

17. A method of inducing an anti-HIV-1 immune response in a subject in need thereof, comprising administering to the subject an effective amount of the vector of claim 6.

18. A method of inducing an anti-HIV-1 immune response in a subject in need thereof, comprising administering to the subject an effective amount of the vector of claim 7.

19. A method of inducing an anti-HIV-1 immune response in a subject in need thereof, comprising administering to the subject an effective amount of the vector of claim 9.

20. A method of protecting inducing an anti-HIV-1 immune response in a subject in need thereof, comprising administering to the subject an effective amount of the vector of claim 10.

21. A method of inducing an anti-HIV-1 immune response in a subject in need thereof, comprising administering to the subject an effective amount of the vector of claim 11.

22. A method of inducing an anti-HIV-1 immune response in a subject in need thereof, comprising administering to the subject an effective amount of the vector of claim 12.

23. A vector comprising a human cytomegalovirus (HCMV) backbone, wherein the HCMV backbone comprises a nucleic acid sequence encoding a fusion antigen comprising the amino acid sequence of SEQ ID NO: 706, and the HCMV backbone lacks the UL130-128 gene region and the UL82 gene encoding the tegument protein pp71.

24. A method of inducing an anti-HIV-1 immune response in a subject in need thereof, comprising administering to the subject an effective amount of the vector of claim 23.

25. A method of inducing an anti-HIV-1 effector memory T cell response in a subject in need thereof, comprising administering to the subject an effective amount of the vector of claim 1.

26. A method of inducing an anti-HIV-1 effector memory T cell response in a subject in need thereof, comprising administering to the subject an effective amount of the vector of claim 2.

* * * * *